United States Patent 9,328,346 (POLYCOMB-ASSOCIATED NON-CODING RNAS) - sequence listing, part 108

SEQ ID NO: 21433 - RNA, 53299 nt, Homo sapiens
cuccggcccucgcccuguccgccgccaccgccgccgccgccagagucgccaugcagaucccgcgcgccgcucuucucccgcugcugcugcugcugcuggcggcgcccgccucggcgcagcugucccgggccggccgcucggcgccuuuggccgccgggugcccagaccgcugcgagccggcgcgcugcccgccgcagccggagcacugcgagggcggccgggcccgggacgcgugcggcugcugcgaggugugcggcgcgcccgagggcgccgcgugcggccugcaggagggcccgugcggcgaggggcugcagugcguggugcccuucggggugccagccucggccacggugcggcggcgcgcgcaggccggccucugugugugcgccagcagcgagccggugugcggcagcgacgccaacaccuacgccaaccugugccagcugcgcgccgccagccgccgcuccgagaggcugcaccggccgccggucaucguccugcagcgcggagccugcggccaagguacuccgccgcgcuccugggcagcuccccacucucuccaucccagcucggaccugcuucugcgggacuggugggcagguugaggggcagcgaagcguugugggguggccagggcaacucucggggacaggcaggugggccccgggguggcggauuuccgcgggcugccucggaaccgagcuucgcgcccagcccggggccgguucugcgcccagacgaugccaguacgcccggccugcacucuggggcucgagacgccgggcgaccggccauggagugcccugagggcaaccacacagcgcggggaccccaggacaaauaagaggaaugggggcauaaaggaaggagagaaguucaggacugggaauuggcgccucgcagagcggcuucaggaccacaagaagucauuucgguugcuuuuucuucuauuuacguccuccguccccuuuaaaauucacugcuuugaucacgggaccgcucagugaaaacuguauguaacucuuuuggaaaggaacaguguuugccggcccgccccggaguuucuccaaaaagucuaccccgagcagggaacgguuuggcaccgcucucguuucggcggcguugcugccugucuugcuuuccucguuuugagccagcccuacaaaaaugaaaguggcuccuuuugaauaagcugaaucgggcuuuggaucacgaaaucugcagaggcggagaagggaccggguuagugaugaggaagaagucuaccccucuguuccuacagccgcacacaggaccuguucuggcaggggagacgguggugaugggggaaggaguggaauggagcaaugucuaacucucucgcgggaccuuccggagagaugcuccucaucuucaggcagaggccauguggaaaaauaauaucgaguucagcagcggccagccccgcguuguaggaaccagacagcggggcuuggcagugcgcuugggcgcagccgugccgcugcugccggaccccagugcugccuccucaacacgggcagugccaggagaggggcauaggggagcacagugcagagggacuggucuagaguuuacuuuauaggaauaugguucggugugaccaacuagggcuuagcauaguuuggcuuacguggacgggaagaugccagagccgaacugggugaaauucgagauugcguauuucaccaacacaggagcacagcccucgggaaacucagccuagucaggcaguagagaguugucccggagagaagugauccugcagacucgagaaggggcaugaugauagcacacgucuguugagcacccagucugugugccggguguguuaccucugugaccucauuuggucaaacgaggaggcaguugcuccucucucucucuuuuuuuuucuuaagagacagggucucccucugucgcccaugcuggaguguaguggugugaucauggcucacugcagccuccgaccccugggcucaaugauucuccugcuucagccucccaaguggcugggacuacaggcggaugccaccacacccagcuucucauucccguuuuacagauagcggagcuaagguugaaaaacuugcccaaggucauucagcuggaauuuaaacccagacagccucauucagaggagucagcccagcacuuaacuccaagggugugggagaggggucaggugcuguaaauuuccuggugggcuggacgugcaucccccucagagcugggaacagcauacacaaagccuaagacuuguuuggaggugaauagaucaguguggcuggggaacguuuugggagggcagcaggagugagccaggcugguggcccagagucccagggcugaagaggcuggcugugccccgugcccugugcgcagauguucuugaacuggagcaacucaaagccuaguguaguguagggcugaccuagcaguggagugcggaaugcauccaggguggagaguuuagacuacugcaauaaucugggugugaggcgacaacauugaaaaagcauguuuuuguccaaaacaagccagcuguuacuggucucgcuguuuguggucucaucgcacgggguccugaguugcuggcaccaugcgagccgccuaauuuauugcuagugaggcaaguugcuuaacaaguuuuggaguuggcugagucccuguguggaggaaaacaggucccccauuggccaucgggcucacagcgggcccccgguguaccagugaggggacagccacagagggauaagcaugguggcuuugaaaggagggagagacagaguggguacaaugcuuuucuuaucccucccuccuucuuuugcaaauauuuauugagcucuguagggugucugacaccguuugcauguuugucugucuggcacaucggagguacuugguacgaguggauuagugaaugaauaaaugaaugaaugaagacaaacgggaggugcuugcgauacacagccauucuguuuuuccuuaguggaaggcacugcuuugcugcgcccccucucuggaucucacacuccacccuugacuuuucggagguguuuccgaggacaggcgccugggagccagcagacuucauucaguccaagccaggcuccaggacucaacagcuggugcccacgggcaggucacuugacgucacuguuaaaugaggugaauuggcugccugcucuggcuggaagauuggcgggagagucacuuuagcugccauggacaugagccuuuucuaggggugccacuugacuagaggccuggaguuggagcaagucauacacggaucuggagacagagcucucgaggcaggagcgggugcugcgauuucaaauauuauaagguggcuuugucuggggcagagcaugccaggggaugagagguagaaaugucaucagaucagggguccccagggaggugacuagcacuuugggucacaguagaucuuuggauagaggaacaugucaccauucaaaggaaagcacuuucaucuguaagcuguuuauugaauagaccucagagaacaucucugcucaccgcucuggaaaugaaggcaaaucaucuauuucagaagucaaugcacuggcaggguuuggaugggaaaguauacaauucagcuagagaacaaagaucugucaucuccagcuguacuggucagaugauuacaaaaaagaaaggaauugaaauacuaauaggguacuaauaaugagggcuaacauauauguugugcuuauucuaugccgggugcauacuaauucauuugauccuccggacaguccuaugagugagugcuguagucuucccuggguuacagcugggcagcuaagucacagagaaguaccuugcucaggacugguggucccacacaacuggauggagagccucguucauaaccaccaugcugugcuguugacagagcaacagagauuuuaaaccaaccccagcuaagccccagcuaauagcugaaauaaacagggcuccagauggcuguggcuuagagauggaacaggacagaucacagccuucacucugcaggcucaggagccugaagacaagguugccuccaguugccgucagugcagcccucacuaaagaaaagcaaaaagagccgagggacuguaggaaggcuguuuccaagccagagauccagacaaacugcucuugaagagagaaagcccuuccagauucccccaugucccaaaagaccagccgggauuccggaccucugcuaaaacauggacaagaagccaggaacgagaccugaaacagacuucccaaacagcagaagccucauccauuucuccugcuaguacauccuccaggaaagcccacccuacuccaugcagcagcccagacaagcuuggaggucugcaagcugcaggggugcccagaaacuccaccccuggagguuuuuaggaucgccugcuccuggucucaccccagagccucuaaaggcagaggcuguauguacauaccuggugaagaaccaagggcuuagaugguugcuuuacuucuuggagcccuggaauguuuguaaaauuuacuuuuuuuuuugagacagugucucguucugucgccuacgcuggagugcaguggcgcgaucucggcucacugcaagcuccaccucccggguucaugccauucuccugccuuagccuccagaguagcugggacuacaggcacccgccaccacgcccagcuaauuuuuuuguauuuuuugguagagacgggguuucaccguguuagccaggauggucuccaucuccugaccuugugauccgcccgcuuuggccucccaaagugcugggauuacaggagugagccacugcacccgugccaaaauguacuuuauuuaggugacucuuucgugggaaccucaaacaagcaaucauugcuagcugagugcugacccuguacugagcucuggggagacaggguugaauaaaacaaagucacugcccacagguaacuuauauucaauacaaugggggaaaauacaaucacugcuucccugggguuguauuuuuccauuguuaaagugggcaguuugcucgagagucauuuucacuauuggcaauucaaauacaccuuuugucaguuaaaaaacaagugugccagggaccugagcuucaucuuagggcaggguggguggaaacauuugugagucuccagcuuuuagucaccugaaacuuggaaacuuggaggucuuuugagcaguuuaugagucucugccugcucuggucggcugccuucuuuuauugcucuguugguuuugcuaaagaguuaaaauauuaaggcuucauaaaauuaggaaguuaacaagcucaaaaaccaaguguuugaguuacuucauuccacugagagagcuguaaauggguugcauuggaacuuaaaauaacugcauugaguaagugaugguggcgggcaccaugagcuaacuguggucagaagccugauggccuccgcuuuggggcuggauucuccguuuggagcugugugauccuggaugaguuucaugccuuggauucagaaaucagacuuuccaugagcuuauauuucaagugaauaaauagcucuggucaggcuuaauuugaagaagaaguaagcuuggcagugggugaggguuccuuggaaggccaacuggggcggaggggcugagggcaagcggcucuggcccuuccugggguguuaccugaccagguaacagcucccucgaccucucggagccucggcagugaggggauugggccaguugaucucugaggcuccuuuuaacuagaauggucugggauuuuucuaagaaaacaagucuuugaggagguuguggucaccucauuccuaauuuaaagccuggggaggcuuccuuaugagcuacuucuuuuuccuaaauuauugaugguuaaagccaaggcuggcaucgaauagaugugauccaucuugagccugguugcuuuguguuucagcuuuguacuggcugcugaaguccccgggagaccacaggggugacauguucaucuccaagagaugagcuuccacgagacucauaccccuugcuccuucccuggggcuccaaggccuuugggucaucugaagugagauacccuugugucauuucaucuuuuccuucuccaccuucucugccguuaaaaaaaaaagaagaaagagaaaaauccuauuaauagagaaaccgagaaguguagccauucugaauguguuuccaaaaggcuccuggaaguggcauggaaguuacagugauucagcacuacuuggugacgugugccuagaaccacagggggacauuagccaggacaacacgccucaggacagaaguaaguggcugcgaagaggcauguccaucacugccggaaagaugcagaguucaguuuuuggagucagugcugagaguuccauuucuaaauucauucagagcauuuauuuaacaccuacugugugcucagaaguguaucagguauggggacucagagguaagggcugguggccccugaucucaagguacucgugguagauaguaugaugcucagcuuaagggcugggcuucugaagucggauugccauuuucuggaugugugguguuucuugggugacuucaucucuaagucucaguuuccccaucaguaagauaagagaaguaauagcagauacauacguagcucuuagggcauugcagaauggaaggaccuccuuauaugaaacgcaaagcacugugccugaugcauugcuagaacucaggcaauauuagcguguugucauugucaucaucaucaucaucaucaucaucaucaucaucaucaucuucaaggcacugacaaaggagucagcugugugggaggagugcugggacacucuugucucccuggggaugagguggguggguggguuaggaaaucuucacagagaaggagggugaugugagacuucuguccgggagcugacucggaauuugccaucuaauauguuggaaaagguucucugggcagagguauccaaagucacuuugccugucacccuuugaggucccaguuguugccuauaucaugugaccaguguguggcuucucuugaauuaagagcugcaugucuggacugccugggauuuuacagaugucaucucguuaacucucccuggagcuugugacacccaggagauggcaguuuauagaagcccuggcaccuucuugaaugaugcuugguuugguuucuaugcacugggaauuccucacaaggaaagauuugucacaucuuaaggaaggaaaaaaaggcaaauuugggaguccauggauacccuauuauuuuagauuccaggacaaauugucgaauaagcacguuucauaaaaacaauccuccgcagcaucccgugacagcagcuggucccucgccacaggauaauuaugucuccuugugcacacaaaagucuccgagggcauauuguuguggcuggaguuucugauaauuuccaaauugaacaaccucaguccuaaugagucagaggcuugugcaauauuuucaaaccucaggaacaucuuuuucauuaguugugcaauaaagaugguaggccuaucucugugaugagcuguuuuuuuuucucaaaguuugaugagauucgccguagaauuccuucucacauagucuugggcaagauuuuacccgaucuuccaacacaugagucaucucauauccugugacuaagaagagcugucucuuuggugccaguuuucuaagugcagucaccacuugauggagacggauggacacaguugggauugcccaggcagaugggcaaucuugccagcuagacauaggggagggaagccucaauguucagcggucacaucugcuuuucuguggcacagagugagcuauacaggaauauuguauucuccaggacaguuagggcagugggaaaugucaucaaacagaacagugacccaaagagccacugccacugggugcucugugggagcugggcacugugcucauuguguuaugggccuugcuuuguucuuaccuuguagccacccagagaggcagggcauuauccuugcuuccuagcugaggccacagaagaggcuccuagagguuagcuguaacuuguccaaggccagccagugcaaggaggcagagccaggauuugagcccaugucuguuucacucccaaacuauucuucagauuucuuuaagucaaguguuauuuagaaauguuuuguuuauucaucaaauauuugguggguguuuccagcuaucuuucuguuauuaauuucuaguuuaauucuauugugggcugagaauauauuuuguaugauuucuauucuauuacguuuguuaggguguauuuucuggucuagaauguggucugucuuggugaguguucccugugugcuugagaggaauguguguucugucauuguugaauggaguguucuauaaaugucacuuaggucuaguggauugauagugcgguucaggucaacuguauccuuccugauuuucugccuacugaucuaucaauuccugaaagagaaguguugacgucuccugagucuauucugaaacacugaauugcggucuccaugaugaaccacuagaguuagaaaaccuggguccuagccccauuugggccuuugggaugacucccuucugccucaguuuccucaucuacaacagggggacaaugaugcugccuaggagacaucagcaggauacugugaaaguccaguggcauaagggguauggaggagcuucgucaacuccuaaagcuucagugcuaggaauccuaaagcauugaaauccaaagauauaaggaauaugaaggaguuuugucaauuccuaaugcuucagugcuaggaauccuaaagcauuaaaguccaaugauauaaggaauaugaaggagcuuugucaacuccuaaagcuucaaugcuaggaauccuaaagcauugaaguccagugauauaaggaauaugaaggaguuuuaucaacucccaaugcuucagugcuaggaauccuaaagcacugaaguccaaugauacaaggaauaugaaggagcuuugucaacuccuaaagcuucagugcuuuaggaguccuaaagcauugaagcuguaagagauuaggaccucuaguuggcaauuccagacucuuccaggacuccugauagagccaacaccaagaauagugaagccagaaggauggaaauaguaaaaugccuccugggugucaaagcaugggucuccucugggcauguucucuuguccuacugagacaugauagcucuuggccaaagugacugaacuugacccucuguuucaggaaggccaaaugcaggguucacuaccaucauguccaagggcagaugcguugguccagaacaucagcaucccaaucauuauaccaagcaaacagccgucucugccugcaccguggagagcacacgcuccuccugggguggccugcauccuguguucuucucaggccgacuuucuguuuaauguuugcuggucaggaaauggccugagcugagguucuucagaucccagucugaccuuucuccaccagcauuuguggcucugaaaaauauagcccagugugguuuagccccacuggaugaaacccaguaggaaaagucugauaauagcagaagacgcacaggaggaagagugaggauuugagagcaucugggaaggaccaugugccuggauaucguucugucugugggauucugugacacuugucauuuacagucuguucccauggaauucucaucauuggccaaacauauaguccuucuguccucugaaaaauaucauucugcuccgaccuuucacacccaucucugaccacaucaacucccuguuugcaugcaucuuguggaugaaggacaccacuuuaccuguaaagacacugguggcuucccaaagccaccaacugacuuguagagaagacagaaucccagaguaugaaaccugagggugaaggguccuggcagguccuagagcucaacccuucacuucacagguggggaaacugagggagccaaugggaacaugacucucacaagcugcacagcucaucuguaggggccaguguggagucuguuuguccugagacccagggcugagccuuugagcccuccgcaucucagccgcauccuccuguuggagcaguuagguguuugggagaggccacgguccaugcucaugguuuuccuguaaggcuggagaaacaggccuuguucccuuagucucucuaaucaaaaugagguugcagaaaacccuucucccuacuucucccuaaaauaauuuccuuggguuagaagaugacuaaaagacuauucauccgaugacugaugucucccuucaagaguuauaagcacauauaaaugccuuugaaugguaauuauaauaauuuugcugaagggaaaauaucaguauaaauaucaugguggacacauggaaugaggacugagaugcuuucaugucuuuucagcugugguuagauuuucuuuaagcagaauauacaaguuuuuccucuccuagcauaaggacucuuuuuuuuuguaucuuuucucucuacuuuuuagacaugauggaaaaugcauuuauacauuugaugacauauuguacuaucucaguuguuuaaaauuauaaauguaauuuaaucauaugaaaaauuaagaaaagaagauucauauuucaccaucaucuccccagaaauaucauuucuuuauuacuauuauuauuauuauuauuauuauuauuauuauuauuauuauuuugagacagggucuugcuccaucacccaggcuggaguaaggggcacgaucuugacucccugcaaccuccaccucccagguucaagcaguucucaugccucagccuccucaguagcugggauuacaggccugcaccaccacacccagcuaccuuuuauauuuuuaaguagagacaguuucgccauguuggccagacuggucucgaacuccuggccucaagugauuggccugcuucagccucccaaaguguggggauuacaggcaugagcuaccaugccuggccuaauuccaucauuucugucccaaguguugccaccguuugguuaacuguuccccuguucacauccauuugggccaagguugcaauguuaaacaauccugagauggacauuuucauguuuauggcuauuucuguaucuagggucauucucuuaggagagguacuaaggaguacaaaaacugggaagaaggauauggaauuuuuauggaucugguauaaauugccaaauuauuuuccagaaggguuguagccauauuuguugccaucagcucuagaauuucaaccucguaagucacugaaagaaauucucccaaaaucaauccuucaggaauaauggaagaagauggugccaaaccccagccauucugcucacuguuagauuccuuuuuuggucuuacagguuacuuuuauucucagguugauggcucuuagaguugagcaauguuugggguagaauaacgagcacuuuuaaaacuugguucuaccuggggagggggugaguugugaucacagacagucucaccugggaggggcuuggguguuugucggcuuguccuucuaacacucgugucucaggcgagcagccugggaccagugaggugaccugaaggcuggaggucacaagcuaagaggcgacagagaacccaggucucaggaagcccagcccagagcucgcugcacugagccucucggaugccagcucuguccaggaugcgggaggaggccagacugauuuggucuguuuugaaaagugaugaaaauauuuauucaaauguuuuguacucauaggcagaaguauaacaggagcugcauauacaaaauuauuuucuaguagucacauuaaaaaaguaaaaagaaagaacacgauuauuuuucuuuuuaaaacagcuuuauugagagauaauuuacauacuauaaaauuuaccccuuuaaaguguacaauuugcuguucuuauauauucacaaucaugcacguaucacuaccagcuccaggacacuuucaucaccguaaaaagaaaccccguauccauuaguagccaccccauacuucuccucugcccagcccuaggaaaccaccgguucauuuucuauuucuaugaauuugcuuauucuggacauuucauauaaauggaaucaaagaauacguaacgggcuucugucucuuagcauaauguuuucaagguuguccacauuguagcauggaucauuauuucauuccauuuuaugauuaaaaauaugccuuuuaagggauacagggagaccagacgucuauuuuaucuccccucccugauggggaauccuaauuucagccuggaaagucacugcgaaagucuaaacugcagaggugauacuguuuccacuggaagaaacuguagcaccugacucaggaagccagcauuaaaaccaagaauauucuauauggauggggauuacgcacugaaaggaaaacaugaggaaaugcacuuuucagauuuauuagaucauagaacuuuuuuggagcuggaaaggaugucggaaaccgucuagccuacccccucaucuuaccacugagguaacugaggcccaggaaggggaaguggcuuguuuuggguccgggaccacucuucauuucuuauuugagccaaagcuuccuucuggcgucugucucuguuucacaaguuccccucgcaugggggcuggguacugcuuggaagaacuggcuucuuccuugauacaggggcucguucaccaucaccucccucccucacgucucuucugccucucugcagccucaggcccuccuccugcaccaggggggcagacucaacccgggugggcacugccucccaguccguggccagaggcuggagggcuagggagacugaacagccccggcagcuccagacauaacaaccuauguugaggagucagggcaggaagcgaacccagcugagaaaucugcgaaggucaggaccagagccagacgcuuaucaagagcaaaguuaaugguuuuugugaaccgagcagucagcuguuuccccgaagauaauaauagacacaucauguugggcauucaggaggcaucugaaaaaaaaaaugugcaguggaauugauuggaagcuuuucccuaaugcauaaaauaggccagaaaagacuaucaaauguaacagcaccgaucaaacccaauagaucaagcaaggacugaaaaacacaauuuuuuuuuucuuugccagugagucugaaaagugauuuucaaugacaggcgccuuuaaacauagacaacauaaacaacaacauaguuguucuggaagaggcaucuuuucccaguaaagccaaagaugcagaucuaggcugugcuugugacugacagcacagugagggguucacagccagcuggccaggugccccccgaaagcacauuucgaaucuacucuauuugagagagacugccuuagccuuguuuggguaagucuuccuccuucacuucaccugccacagacuuuuccaggcaccaucugcugcagucuuggcccagccccugcaacaguuacugcucaaggcacccgggacaugcaggacgggggagcagccugaggucuggcguccggcgagcuuuucccacuuggagccgucugggagacugucccggaaagagaggggcugccaacacuuggaagugccaaugugugcugcaagucgaggccaggcucccggcucccccgccucuuccuccuugauucauuaaaaggaaagaaagaggccacacgaaacucuccugaauuucauuucuuuguuucuaugcaaaagacagagcguggucauucaucauucaaauuuuagccuuuuuaaacaaauaauaauuccugcuugugaauucaguguauuuuaacaagaguaggucugagggccguuggccgugucuuuccuuagauuugcagacagcggcccugauggugcauaggguuucagguuuccuuuagaccucagcuggcugccugggccaccacuuagcaaugccauuguccuuccugugcauuuucuuugcagaauucgaggaaauccagucgcacaggccccucugugcccauguccccggcgcccuggaaugugcaguaccagcagcagcgauuagaaugggggucugguuucccggaaugugcaaggucuggcuucuguuucugcugccuccaugccccagaccagugcugggccgggcucugggcuggagccguggcugacaaguuuccuuggaauuuaauggagcgggccagacagcaugcagccacucaaacugaaaaccugggaaagaaaugaguguuguggggcagcuuugcugcauucacugggucauauaugcuucuuuuucuuuuccucaggcaaccccucuugcagacaggaggcccccuccccuuucgcuucaugccucacuggccauuaggaaccuuuuaaaacugauuucucuccugacccucagagagaacauaguccaaguucccuggaggaggaggaagcgcucuguguuucucugcaguucacggcucaguuaaaugcagccuacgugcugucuuuccccacuccucugccugcucccguugugcuucucaugaucauucucaaauucagcgagaaaccucacaaagggagcuuuucuuagggaagagucauccuuggccucccgaauguggaccagccccucuccccagcugcacagcaucagguuaguuaaccaccugccuccaucuggguccugucuggacaggccuacucacaccugcugcaggcauccaacuugcccucaggugccuguggcucguccagagggguggagcccacauuccaguccugacagguaaaguucaguggcggggacccugcauuuaguguaaagaucaauauuccagguccucucuuccugccacccagcgacuggccguuugcaggcacucggucccaguuguccugggccugcagcccuugcauucucucugcuuugucucugcuauugcaccccugccccaucagaaaugcaggugggggggccuuccgcugggacagugagagacuggguaguaaggggagcgcuagagggaugguugcgcuugcauccagcccugacugcauucgcucucccccgccucucugugaaggugcugagcugugaguggaaccaaguggaugagaguggccuugggcaccugccgauaaauuucccggugugucuucuccuccugggagucccaucuggauuugggucuggauuuauuuauucagcaaguagccucuuuauaguuacuuuuuuuuuuuuuuuuuuuuugagauggaguuucacuuugucacccaggcuggagugcacuggcgcaaucuuggcucacugcaagcuccgccuuccagguucacgccauucuccugccucagccucccgaguagcugggaccacaggugccugccaccaugccuggcuaauuuuuuguauuuuuaguagagacuggguuucacuguguuagccaggacggucucgaucuccugaccucaugaucugcccaccuuggccucccaaagcgcugggauuacaggugugagccaccaugcccggccuguaguuacuuuuaauuuagccaugcucggggcugaaggggaugccaaagaaauauaagaugagccccucagacggcuaaagaugaagaugaggccuccaguauguaccucccacauacaccccaggaaauucugggugucacuggauucuggaccucccaaaagcugcuggcaccuggaggauggggccccgaggcuggaccucacuccugcuggguugcuggacugggaaaguacugauggcagcugaggagugugucccagacuucacugagccauucccaaagauuauuccaaguucuccugacacugcacuggaggccugcugugcuggccuucuuuauuuacaguuucugacuggugucuagcagcccugccagagagagcggcagugugucugcaggcgaccaggagaaaugucucaggcuuuagagcaggacuuugagcacauagcugugggggcccagcaggcugucuccugcacgguuacuucuccuuguccuuucauggucgagagguugcugccuggcccuucaagugaggaugggacaugcuauccauuggccuuaauuuccaaccucugcaugaugcauuuuaugcuccugccuuugaaagaacuuuuauuuucuugucauuuaugcccagaccccacauggcagaaggaagggaggcugggacaggggaggcggauaagcugccgcugacagaccugcccaguuucuuagcucaucccggccuccauccuggugagcagacacuggcccaauccagccauauuuuuggcugaguuucugucuucacaucucauccuuaacccugaauccuggccauaguugguacuggguuguauucuuauuuguaaucuuuaaaguaggaauaccuuugcugguauuuaaaguggaagaaaucaggugaagaaucacaagugauuugcaaacuggaagagacauuagaauguaaaugugaggaagcgucagcaugaggggcuugccugggcugcacagcuugccuuggcuggaguaugcacuguucuggcauugcagagaggauggguaccuugccucccugcaggugggggacuguaucagcccccgcagacugcuccugggcuccugaguuugacagauuuuuuuuuuuuuuuuuugagacggacucucacucuguugcccaggcuggagugcaguggugcgaucucggcucacugcaagcuccaccuccuggguucacgccauucuccugccucagccucccgaguagcugggacuacaggcgccugccaccacgccuggcuaauuuuuuguauuuuuaguagagacaggguuucaccguguuagccaggauggucucgauuuccugaccucaugaucugccugccuuggccucccaaagugcugggauuacaggcuugagccacucgcccggcugaguuugaccagauuaaggcagcaucuccaguggcaccugagcagcuccugagaugcuuuucugugcuaaaucuggauuugggguauuaaaucaaaugaauuugaaaugcaggcacagcuggccccaugggcauggaccugugcagucacaccuugccccguguucagaagggugcugugccuguuuuaaugcucugcuguugcucucuugagauucuuaauaauuuuugaacaaagggccccacauacucauuuuguacuggguacugcauauuauguagcuagucuugaaucuaggacagugcauuaaaaugccauugauuggaucaaucugcucuugcaacugauuugaauuuugggaacaugcuguuuccugugaauaaaggaggauucauuucuuuucccucgaauacacugcguucuguuuuccaaauuagcucuacguaucaacucagcugagaaauuggaagcggggauuguucuggcuggaagggaagguuagauuguuaauccugcauccuggcccugaucucaccgagugugaagcauguucccacaauggugugggcugcggggggcuggaggcuggcugagaagguggggaccaaggagggaggcuagccugggagccagacagaugggguuaggcucuugcuuuugccacucgccagcucugaggcuuagggcaacaugauuuaauucucugauccuuguuuuuuucaucuuucuguagacuggugaugagaugcacccugcaggcuugcaggcuugcaggaguaauuaaagguaauauuugugccuauuauugggcuugacauauaguagaugcucuacaauaaauagauccuauuauucuuauugauaauauuauuuuauugcuaacauugaagguugggugggauuugacuagcuggaggcgaggagaaugagaucauccaggccggaaggaaaagagacaugaaugcagggggaugggguggagcacuuuggagguguggggagaggucugcagggugggaguugugcauuaaggagucguggggagaguggaggaaucagugccacauggugaaugagaggggaucgugggcccgaggagauggcgauggcugcggggauccugcaggaaguuuaugugccccaaaguggcauuaucaguuagggggagacacugaagacagaggugaggccugccugaauuagcguagagugggauucuuggaagcuucagaagcuugagaagagccacuuggagguguugaaaugcaccugggagggacguggggacccagcucugggcugagagcugggagacggaaacgcaggugaccuuggccuugaagauggggcaugauauuuagugcuuuaugugcaaucucaccuaggacucccaagcccuuuggaguaggugauauuagcuccguguuacagaaagggagacugaggcugaagcagggacauucaugaucugaagucacacagcuguacggggcagaagugggcauggaggcauuaacuuagagccgaaaggugugaccuuucuuaguguggcuggccccacggggaacguguguggguuggaguacaacuugguguuccuacccaucccagaugcucugcguuugugaaccccaguugccacaucagggcgggcgagggcaggaagcucugcagggagaagggacaagggacagagccaagaacaggggcagugccccaggguccugcaggggcaaugaaggggguuggcacaccuggguuaguugcuggccaguguggggagagagcuggccugggagucuaaugggaaugccagggaaagcugccuugguccccuaaagugaagcccccaugcuggccauggaguguuggugauugagggucccugcuaguugucuggccgaggcagcauguccuauaggcauagcucugguguccugcuggcguggcgugagugccccucaugcugggagccagcccugugcucuggagggagguggugggaggacaagggacagugggaccugccaccugagcaggaauuggcaccuucucccacuggcagguccagguuuuauggaaucugaaacuuguacaauucaguauacccucuucaagaaaaacaccccucaaaauuaugaauauaacauuagguaugaaacuauuauugauauagauugaaaaaagaaaaugcccaaaaugacaaacuucagaaaauagacaaauacugcaaacaucacaaaaucagaaaaauaagauuaaaaaaagcuaacugcugaacacuccgucaucuugaaaaugccccucucuccuccucuauuuuuuggcugugaacucuuugcucaccuuuucaugugacaaugcuuuuguaauauuuccuacagagaaaauagaauaauuuauuauuacuuuuauuguuuuuggauuauuauuaugaucaauucaauauuuuucugcuacccacacacucacugucuucuguccaaccucuggccugcaccaggggaaccagcaguuuccccugccauagggugucccuggagaccacacauauagcaggauagauauagcaauuuaacuagacacagaagggacuucaaagccacaaauauaucucauuuaaccugaacaaaaugauuauccaguuuuacuuuucccuuagccucuucccccaaaugcuggcagccacccugaugggauagaugugugacagagggcaagagaccguggccccaaccagcugcagcuucacucuuucauuucuguauacucucuacaagcugugaugauagcacuuugcuagggccccucacagggcagauggagggcuccacgcugaagcuuuguggauguuugcugucuauccaccucugcuccuugugccuaugcagggauucaggcccaaccacugcagagagcccaagagcaucaggcagagguucccaaacugucaugauugguggcaccuuuaguaguugauacgguuugguuguguccucacccaaaucucaucuugaauucccacauguugugggagggacccgguuggugguaauugaaucaugggggcagaucuuucccgcacuguucucaugauagugaauaagucucccaagaucuguuggcuuuauaaaggggaguuucccugcacaagcucucucucugacugcugccauccauguaagacaugacaugcuccuccuugccucccaccaugauugugaggcuuccccagccacguggaacuggaaguccaauaaaaccuccuucuuuuguaaaucacccagucucagguaugucuuuaucagcagugugaaaauggacuaauacaguagugcagucauuuuuucaugguccccaguaaggccaaaaaauacccaacaguuccauuuaucaauuaguggaggccaaacaauuugauaaguauuugugucccuauaacacaguggucauuaaaaaaagacauuuuaauuucauuauucaauaagcaugauuacuuaugaaugggauaugugcaccuguugggugucacaugaccuuucaaaucuuggagucagauuggacaccaccaugcccauuuccaguucaacucugauuuuugugugguacaugcuuuuuaucacagugacugccagaaauccaacuucauauggaaucaugaaaagggauguagugugaucugauuucaaaacuaugaucaaucuagagcuaguuuacaaggugucuaacagugaucaaguaucacuguauuucccuagaaaaccugaaauaucgaugaauuuucuguggcacucuggggucccuuggggcacacuaugggaaccaugggauuaggaccauaaggauaugauuuuggcuucuuccugccucagaucuaaucuuuaccuggcauuuuugccuuaaagaugaaagaagcauacauuuugauguauuuaaagcacauauucggccaggugcgguggcucacaccuguagucccagcacuuuggguggcugaggcaggcagaucacaagguuggaaguuugagaccagccugaccaacauggugaaaccccaucucuacuaaaaauacaaaaaauagcugggugugguggcaugugccuguaaucccagcuacucaggaggcugaggcaggagaaucacuugaacccaggaggcagagguugcagugaaccaagauugcaccacugcacuccagccugggcuacagagcaagacucugucucaaaaaaaaaaaaaaaaaaaaaaaagcacauauucauuuugugcuuauucuuuugagagaaacacagauaaaagccuauccuuuaauucauacuccccauacugugauuuucauuuuuacugcaacaaauuuuguucagugugauaaugaaugucaaacacuuaaugccuugcucuuuucaguaacaugacauauuggagaauaaugacugaagcuuaucuacacugccuacgucuguuuucuuccaccuugaaagaaguuguugaaaguaauuaagaaguauuauguguaaaacuccagggaugaugugcuucaaggaagcaacauuuaugaaguugugugcuugacuaguaguuuauaaagaggaaagacgaaucauuuauugucuugggauugaaucuuggcaauuuuuaaacuauaaaguuacaggaaauguuggcugcucuuaaugggccauuuguuguguuaaaaaucaguaaugagaaauauuuacuagguaaguggaaagauccaucucuauaaauuguuguaacuuaccauuuuacaaaucuuaguuacucaguuuuucugcuuaaaaaugaaaucauguagcacuguauaagucauucaguuuuuuauuuuggagaauuacucuggauugucuaggcucugugcucuccacauauauuuuugaaauaguuugugaauuucuacaaaaacuccugcucagaauuuucacugagaguaugcuuaaucuauggguuaauuugugagaaauugauagcuuaacaauagugaaucuucugaucuacaagugugguauuucucuccauuuauuuaggucuucuuuauuuugauagcguuuuguagcuuucaauguacagaucuugcaaauaucuuguuaaauauuucccuaauuacuugauauuuauuuuugaugcuguuauaguuauauuuuaaaaauuuugauuccaauuguugcuaauacauagaaaugaaauuauuuauugaccucuuauccugugacauugauaaacgcagucauauauucguagauuucuagaauuuuucuauauagacuaucauauauaucaucugcaaauaaagacgguuuuacauuuuccuuuccaaucucuaugccuuuuguuucuuucucaugccucauugugugguccauuacugaacggcagccaguuccagcuuucuguucaauuaaggagcagguaaaauggccaggccuugaccuuucagggggcuucccguccucauugccuucugcugccucaguucuggcuuaacagaacaguguggggaggaggcaugguccuuaccuacuagggcguuacuuggccuucuucagguugguugcuucgucagguuuaagagcucaccugggcugcaguucaggcuagguuaucugcugaccuggcccugucucccuucuguagugucugugggguacccuuguaagcuagggagaagagacacacgugaaggccagaaaaaacagccugccacacagcuucccuggaucauaccuucgcagugacaugacgacgucguuaggaggcgccgagguggcugagugggucuccagacaccucccuuuaccucucugcugugccacugaugugugacuugcuuacaccuaugcagagcugccacugagcagcacuguggccaguccuuuggauuuucuucuuucuaaauuguaugccguggcuugaucaagcauuucauauacaguagaucaugaaaucagcauagaaaacacauugagguaggugguguuaccacauuuuauggaugagaggcuaacacuuggaggagucagguaacauguccaaggccacacagcuagugaguacccugcugagggucacacucugguccaucugaggccagagccugugccagccuucuccucaugcugauagacgaggaaacagaaagaaggagcaguggacgcccccacccucuguccccugaaccccuuggagaguaggcaguggcagagccagccugggcccaucuaugggaauucuccaucgggauugacuccucuggaaggaagacaguugacccacaguugagaucacagcagaugggccagccagggugucuguagaccaucaggcaguggccacuccauguaguuuaauggacaagcccuuuuaauggaacaggaaucuaacacugaaccaagcugcuuuuagacacacuuuuauuccucacucugaaauggcguuuggacaagccaaauauuucuucuucuuucaguugacauuuuguccaucuuugaacuguuaguugaugcuucuucuguuuaguuauuccuguucuauuuuccuguugccacuaguccacccagggaugguaagaauggaagucaaugguugcuuuuucaucugagaugcaccacgaaggcuugucagucagccuugucauauggucugugcucccacugcuccuucuuucuguuuccucaucugcagaauuuggagaguccuggaccugaucucaaauuucacauguuauuuaucuuccugcagcacgcuggggagaggaagagacagggacauagaagguuggagcuggaacagacuucacaucucauuccagaggcauuugguccaucuuacagaugaggaaauggaggcugcucaguggacugaggcuggaacugggccuuccaguggccaggccagauccuccuugaucucccuuguugcuuuccuggugggaagacccuggaaccacuuuaugugacugugugagaagggaacugccucucauuuuacccagcaaaauccaccuucaauccaucuucauuuuugccccuggugugggcaaauucucccauaccuaauucaggaagccagaaagaggaagugaguuaaugauccuuagugggaaggcgcugguaaugguccuucuugugagaguuucugaaacaccacgcugucucuguguucuggccuggcuggaguuaaaccucuucuuggccuuuccccaggaagcuggucugaggaagcccagaugcguuuguuuacagcugucuggugacauucgccaggcucuguuuucagaaggaacauuuccauucccuuauuuacaccucccauuggagugcucggggggacacaccaauuauuugcaacuaccuggaaaccuaggaggguagcagaucuguaggaggccaguguugaagugagaagcuguagaucuggugacacugugggcuugggagggcuugcccagaucuguuacuuauacucucuauuaagaaacuucaguguccauggagaaguuauuuaaagucugcgagccucaguuuccccauauauaauaugggaaggauaccugauuuuccuauuccacaugaagguagaaaaaauuaaauuaaggcagccaaugaaaggguuuugaaagcaaaaauaauaauaugauacuguucugaauuuguuaaauuauucuuccaaguaguugcagaucuuuuucuguaccuuagaaaaaaaccaugcuauguaaaaggagaugauuccaaucuuuaaauaaagcaacucagaggucaggggcuaggacagaaaacggcccuuuguucacagaagcgcucucacuuccaagaaagcaagcgugggagaggcaggugguccucccgaugucccugugccccauggugucaagcuggguuacuauggcccuucgugacccagugcagcagggaugugggaaccagugggugugaagcugugacgggucacaagagggcugggacgucucacagcuuuuacuuauagccuagagccuggggaaggguugccacucuagugaugagagaggcguguguguguguguguguaugcgucuguauguaugugugcauuugcauguauauaugugugacuguauguaugugcacaucugugaguauaugaauguguguggaaguguguauagguguuuaugugacaguuuguguguaaauguggguguauguguggguguguuuaugcauguacaucuguggguguguaugcauaguguguaugugugaguuugugugugugugugcauuugcaucucuguguauauaugcauguguguuaggggcaggcacacaggccuguugguaaaugagacacaaaauaccuacaaaauacaaaaugugagacaggaaauacaagccccaguuacucauuuuucagugcaacagacauaagauuaccaugugaaauugcuaugaaaguuuccgaaagcuuccugucaauucguagugagcagcuagcagaggagugcgggucccuggagccugcuugugcaacgcugagcuaguccaagggggaagaauggggugcauggcucucagcugcagaccagccuggaaccucuccagccugcuuuagcagagacuuguuaagagguagcagcagguggcaagauuaggagccggaguaguaggcuaaggcugcacuuccagggacacacugccucugccaccacccgugccacgaaaaugggagcccaggacccugaaucucuagcaguccguuucugaaucaguuaccuuggguaugugccucugguugauggaaacuaacuuguagcccugcugggugagagccucacaucgggacaugugacagcuuuguugaaaguagcuuuggaaacgcccaccacguggggccacucacuguaauauaaacggucaugcaucacugagcaacagggauacguucugagaaaugcgucguuaggcgauuucaucacugugggaauguuacagagugugccuacgcaaaccuagauggcagagcccacuccacaccuaggccagauggcagagccuguuguuucuaggaugcacgcccguacaguagguuacuguacugaauacuguaggcaguuguaacaauggugaguauuuguguauucaaacauagaaaagguauaguaaaaacaaugguguuaugguccgcggcuggcugaaacguuauguggugcaugacuguagguauaaagcauuacaguuguuugauuuuucucuuuuucucacccacagucuuaaggcaccucuuaugccuuuugucugggaugucccgggcaggguuggaacgugugguuaaggcauggcggaaacugcuuuggggacagacgauggccucagcuugccuuggggugucagugggaaagauaggagcugccccuuugccuucguguuucuucguaauaaucucagauguacccgucuggugggccucuccuagaaaaagccccggugcucuuugcuccugcgguguuucucaggaggguuguugcuucuuuguaaugguggggacucagggaagggacgcaggcagagggugaugccacaucaaaaagggacccuuggcugggugugguggcuuacgccuguaauccuagcacuuugggaggccgaggcagguggaucaccugaggucaggaguucgagaccagccuggccaacguggugaaacccggucccuaguaaaaauacaaaaauacaaagguggugggugccuguaaucccaguuacucaguaggcugaggcagaagaaucgcuugaaccggagagguggagguugugaugagccaagauugcgccauugcacuccagccugggugacagagugcgacuccaucuaaaaauaaacugaaaaaaaacaaaaaacaaacuugggccaucagcuucuuggaaaggcuggugugagguugaagcauuugcuggugccucugcucaacguuuuuguggugaaccugagcaaagagguuaucauuaguggauuuuacugccuuaccugggugggcacucccuugggagguggauggacauuugcagcugagcccaggugggggaauugcgcucacuccgccuucagaauuccaaaggcugggcaugcaucuuggcuuccucuaacccaugucuuucucuagguggccacagcagagugucauuaaguaucuauucuuugcuuuuguucucagggcaggaagaucccaacaguuugcgccauaaauauaacuuuaucgcggacgugguggagaagaucgccccugccgugguucauaucgaauuguuucgcaaguaaagagagccuuccuuuuuccuauaaccuccgaagcuuucaccgccacuagcaaaacaugagagcuauuuuugagauacauuaaagugucaaagugucacugaauaucuuccuacuuaagauaagugugucucccuuagaacauuuucccuauucgacuauauaaaucuacauucuugacccuucugaauguuuaaagaaccucgggcucugaagagauucucuaagaauauuuuguaaguggaaguuuuugaugcaugcaaaaaauuggcaggauguuuaguguuuaaaugcuaagcccgauauauaaaggagcgauggcuagguguguguggcuguugcacaacccauuaaucaaugcguugaagcguucauuuuaaggugcuacaggcuuaaguguguacuccuuuggauuuuaggcuuccguuuucuaaacgagaggugccgguggcuagugggucuggguuuauugugucggaagauggacugaucgugacaaaugcccacguggugaccaacaagcaccgggucaaaguugagcugaagaacggugccacuuacgaagccaaaaucaaggauguggaugagaaagcagacaucgcacucaucaaaauugaccaccagguaaggguguucucgccugcagaggugaguucucagaugccccggaacacccuuggcaaaggcaccagagcucucugauugcagcugauucucggggggcacugaagccagucugagccagucacaggagggccuugaggagaugcugaguauggccugggggugugggagaggaaggggcucaggaaaacuucuguaaggagccagauaaaaguuuuuaaaauaauguuuuaaauguuugucaaagaaagcaauagauuuguaaagaaauuaguagguaaguagugaaaauugauucuccuucccauucccaauccuguggcaacucuuguuacagauuuuauuuauccuccacagauacaucaugcguucacaaugaacauagaauuuacuggguuuuagacugagccauccuuaacuugucaacaguuacuuugaaaacaaaccagcucucccaaauugggguuuugcgggguuaugagauguguuucaaaagaauguuucguacuuuaaacaucuuggaaaacuugaauuaaaacagagcuaauggauuucuucuuuccagaccuucucagagcuuuuaguaugcuagugugcacguggcuugccuacaaaaggguguugacugaacuauuugcccaaauuauaaucauuugaguauacagcuuuuugugggggcaggcagaacugagacauaccaaaaucaguuugggaaaugcuguauuugaaaaugcuuucuauuuaaauauucucuuugcaaucauuuuugcucuguugauuugcuuagcaaagucuucaugucugggacaauauccauuucuuacugacucaucaaaaacccccacucgacacgucgaugagagagguuuuguuugcuguguggcauguucagugaaagcgugguuuccaguuucuucacauccuuauaauuuucuagacuucagauggagggaacaaucagaggaggcuggaauccugccucugaccaaggaaaagaccagaggcugagccagguggggucucuuguccagcccucugcuugccucgcuuuaccugggugugggcugaguaauuccagacaagcguggaauuaaucuggcuguuugugcuguucaguggcacgcugguuacaccuccuucuggaaacaacucugcgugugcuguuugggugguaggauuccgggucuccuucuccgucuuuuuauaacaucaaguugcugcccagcucaggcuccuuuacggccagucuucagaaaaccaccagcuaacacauuuacuacccuccuuccccgauguuccuguagcuucucuauggcuggguggccaggcauggccgaagaggcucuggguagauauaggcucugugcccgguguguguaacuggccuugagugaggcugcaguuguguguuauuucuauuaggucacuguggaauuucuagcgacaacuaaucuuucaaaguguguuuauuggucacaggauuauugggccagccucugccuucauucuuuuucaccuaaucugcauaauagcuguguuauccccauuuuagagaagaagaaacaggggcucagagaagucuaguaaccugugugaggccacacagcaaacaccucaugacccugcccuccuaaggcagcccauggcuacugcuggagggauagaggccggccccgugguuugaugggacagcuugaccuuaaacagcccaugggaaggcgggugcaucugguuuaggaacaggcugcuagaaagguauccaggaugugguagucucaccggaaggagccagucagaauagcacagccuguggccacgcgugggaccuguucagccucauggagcuuugggaggcagccagcagcagggcaugggcugugugcaggcgaggcgcuggccuggacgccgcccccacugcguaacuucguguuuggaaugcgugggcacauaccgugcggcugcuucuggccgggggauauucuuuuccaauuuugagccaagguggagacugucuccucgugccaucccuggcauguccuggcaagacgugaacgaucucaauagacgagcuuugcagagugugucugaccugacuccugcugucuugggaguuuagcucuucagccagcagcaugcuguuugacauguguuucaagccccccaagaaagggugcuugaaauuuaaaauugaacugauguggcuuuucaaaauggaauuggaaaugaaaggauauuaaauugcagacacccacacaaaagacugguuuccacugacuaaacugcuuuuuuuugcugauaguaguugaaaguagggagaguaacagcaucucuuccagcuuuuucucuuuuguucccuuguuuugaugauggguuauuucgggggaagcucuggcuggccuugcuuugugucaucuuagggauaacaaagaggaugaaagagaucaggaaaaccgagaaggcagaacagaaccagcagaaacugugcuugaggaaugaaaaucaccuacacggcuccuugucauaugagacuguggcccagccuccugcaaagccauuuaagaguaacccagugaagcuggugagacugccugccgcguccgugggcccagugacuaacucgguggcuuaucaucugggcccagcuccuccccuggcauccugauuucacuuggaggggcccccguuguccuucauaaacauguuuauuucauuuuauuuuuauguuuugagacagaguuuuacuguugcccaggcuggagugcaguggcgccaucuccgcucacugcaaccuccaccuccaggacucaagugauucuccugccucagccuccugaguggcugggacuacaggcgugcaccaccaugccuggcuacuuuuuguauuuuuaguagagaccggguuuugccauguuggccaggcuggucucaaacuccugaccucaggugauccaccugccucagccucccaaagugcugggauuacaggugugagccauugcgcguggcuguaaacgugauauucuugagacuuucagugaaauaagaauugccacggacaucuguggucauuguccacuugccacucaccuacccccuuuucuggcagcaacagccggcauuucacauguccaucaucggacagcguaggugggaccaucagucaugguguccuacccucuguggccaaggaguggacacaggacccaguuagggcaagcagaggcuccccuuggaaucgcaaagugaagcuggaugccacccacagagacuaacauggugaagcugcuguagccccugcuguugagcccccagcacugccugaguucuugcacuuugugaguccaguuuaauaucugcuuuuccucccauucuuggagcuccccucacaucuccaguggcuugaaguugccagagauguuucugggcuugugaccaaaugacuccuuuucugcuucucacugcugagcagacacaugugcgcucacuuugccugcugagucuugggacccggaagagcuuuugggagacaaucacggaccagcccccucuugccugcccugcugucucccuccaagcaggaggugagaagguguccaccugcagccccggccaggcaucccuuucugugcuucugcccaaaucugaaauuccccucuccuugggacccacgacuggggccagccugccuggggagggaaucccagcugcagaaagucgggacagugugcguguaaacauguuaauagaaagcagcuuugagggcagacuaguucagcuucaguuacaaacucuuuccaaaugcguuuaacaugagccacuggcugugcgcagcauaugucaagcuuucauccaaugguggcauuuugucccugcgggguuuuuuuuuccugagcaguuuggggcagggguggggacagggagagagaaaaguaaaaagagagcaguuugguuucuucaggcuggaguacaaggcagagguaaugggauguauugaagaagguaggagggaaaguuacuuuagcuacagcuauuuguccagcugugcugauuaagaaacuuggagaaaagcaucuuuggaaucauguccuucccaucuuauauacagccuuugcagauuuccugcuguucugagagagaucugaacuccuuaccaggaccuugagggccccaccugauugggcaccccucacucucucugccccuccuccccuuccccuccuccccuccuuucuccacccccaccugcucugcucagacaccccuuccuugguugcuucccacaggccagggcuguccccuggggccuuggcuguuccccucccaggagcgccccucuccagcuccucaugcagccaaccuuccuguccuucaggccucugauuaaauucugccuuagacaucucuccccaccccgcugugugagguagcgccccaugccccaguccccucaacuccacugccucacuuuggggacacaucaccccagggacaacugcauuccacucuugguuuuucccuccucgucuauuuaucacaauuuagagucgccucacucauuugucaaaugaaguucaucucugcagcuggacugcgggguugggggcacauccggcugucgguccucagguaggaggugcuuggcaaccuuguucagaguaggacguucacagcugucugccccggaggaagcaagggcacccgccacauggauggaauugaggggaaggcacccggggcuccugcaucgagcuucccuccuauauucaaugaggaaaugacccugcagaaggcuggcugcagaugccccugccucccggcuuugccugcuuggaguuugauggacacgugguccugucagggcuacagcaggucuauggucuuugguaacggaaagcgcuggugaaacagugagcuuucccgugggugcuuuucccugacgccaacaaccagguaaauauuuggaaacggccuuguugaggcuugugaggugguuuuccucccuccccuguaggccugcgccacccccccaaccccacggccaccuuugggccagauggcacccacagaccuguuugaaguggccacagagggagcccucugggcgcuggggccgcuguguuugcagaggguccucuuacugcugagcuggcuggugcagugagaaggaaggccgacaccccugauccucaucaaguucagacgggggucacugcgggugaggggccuggggccuuuuacaugucccgggagcugcugagcaggccacucuucuccaggccaccagaacuuggcccugcgcauggugaaucuucccugagucagcugagugaggggguucaggcagccccccgggacauggcaguggcggggaguggacugggguggugcuugccaugacucacgccgguucuccucaggcaaccggauggucagaugcgcugacucaguggccugagcucguccaaaagcgaaucagagaacacagggccugggcucacccgcugcccucuucuggagucaucugucacucauccucaugaaggaagcgccugggagccuggaaugcacaucgcacugccccagcuccccucuuguuucuguguuuuuccauuuuggauucuuucccccaacgccuucuguacugggcauuuuguggucucuucuuuuucuccgagaacucugagggcuaccauugcauuugcuaaugaugccacagacgguguugacguuaugaggcuucuauuacuguauugauuuuuaccauuuuuagggggacgggaaucaauauuucaugagggaaugugaagccagacagugaaguagaagcuggcuuuuauuuugugccaggcuuuguccagaggcggguggggacguggcuccuaagcucuugauugcagcuccuucuggcuugggaaacguuucaguuccccaaacucucagaacuggauccccuguguguucucuggcccggauucaagaacuuaguugauugucaaggaaauucuuuggcuauauuuuucucuuaauaugguaaugccuuuuuucacucuggcacucucuuuucagggaauuggauuaagacuauuauuuaugggucugacaaagcaguucccaaguuguugggacuggauuuguuuaggaaugucuccuguccucuucauugaggggggaauacaaauugcuuccauuugacaguuuaucaagugugugacagaguaucagaguccaggguuggccaacuacagccaguaguccaaagcuggcccucuguuguuguaaauaaaguuuuauugggacauggucaugcucacuuauuuagguagaguguauggcugcauucagucuacaccagcagaguuaaauaguugugaugaagaccacguggcccgugaagccaaaaauauuugcuuccuggcccuuuacaggaaaaaaauucccagccccaguggcaggcaauuaacaccuuguccucgaggagcugaaaguggcuggaggcaggaaugcuuauaagaaccaagcgaggugaagcacuagguggccgcggcgagcaggaagagaagcugauuuuguuugcccuuucguuugccagagauuguggguucuuuuuuuuuuuuuuuuuuuuuuuuuuuuuuugcagagaugaagcuuugaucuugucacaauagcagagggaggccuuauuuuugucuauuucucugugacauugguagaaaggacuuugucagaauuccaagcuauuuggcaauuauccaauuuugagauccuaauggaucuuucgaggucuaguuuguucauucuuuuagugauuccuuguuaauucccugauuuuauaaauguguguugaacaucugucuuggccaaauacuucuuaggugcugaggaugcagcaauagugggcaaagccauggggcuuaagaucuagugugggaaaugggugauguaaaguaaauauggcgauaaguacagugcacgaagcaaacaagugaagggguagaagguaucaggcugcaaagacagcagauaguguaggcagggaaucuuaucugagggggugacaucuaagcugagauggaaaggacagugagagccagccaaggaaacaaguugggugacaagaguugcagguggaguugcuuaauuucccacuucugcucagccugcagauccuggaucuuggacuaauugcaaacugucauuuccucgugaguuuauuagaacccuccagaacaaguuucugguuagcuaguuucucuguguguugucucauuucuuguugguucugguucuuugggguuccuacucauacucuggaaagcuccagugucuuaaguagucagucucccaagagucugaaagcacaaagauucacaaugauacgaucaccucucaaucauagcagcauugaugcaguuccguagcugguuuccuaaagccauccagaucucuuucuguggcaagagagaaauaagaccuucuggugaauugaggacuaauuauccuaauaaacaugcgaauuaacaguuccuuugguuaaacaaagcaccagaaucugauaaugggaacaugugacucaugguauuuccuucuuugcuuuaucuaccaggcagcucacagaaaccacuggccuucccuguguucccauuuuaugucauaaauauauauuuaauuaacuuauuauaaaaggcccuuuguucauugaccauaucaaauuauucuuauauagaagagguuauacauguuuuaaacauuuuaaaauaaaucugaaaagaaugcuacauccugggcaacuucccugcauuuggggcucaaagaagcucuaugugguuauggguaaugaggagccagagugccuucagggcaguucagcagaugcugaaaggcugcugugugcuguucgcugggcccaccaaauagaguaggacugagccccuguccaccaugacagccgggagauacaagcuguucccuuugccucccugagcccugagcuuuauagccuauagacagcugaaaagcaggcugcauccguuacccagucaguuacccagacccaaaugccaggccuuggcuaaccccaguuauuaccuaauuuuaauaucccaauggauguuuuaagaccuggcugguucauucuuucauuuauuuacuuauucauugauuuuguaaauauuucuggagcaucugccauggccacaugcuguuguagcagcaucagccacucugaaguugguggaugaaaggggaugcaucaaaggcgcugauguauggaggagacgcaaguuagacuugaccaagacaauauuauuccuccucuggaugccccgaauauauacagucauuagcugucgggcccccauguggcacuguugacauuuugugguuuaaacacugaagaguaagggaauauuggaaauggcaaacaucugauauaguguaaaggagacuaaauauuuugaugguguucauaaacaccgaggaggaaagucuuuucauuuuuuucauuugugugcucucucuuucucuguuuuugcacacuguccucuguucuccuucuccuucucuuuuuccuuuuuucucccuucaucuccccauuuaucugaucucucccaccugaaccccuucuacccugcugcccuccuguccauucuaccuucucuacuccccucccuagacaguaguaaucacaugucaguuggagaaacaugauggcaacuuggucacaccguucuucucagucuguauaugucggugaucucagugcccaucuggcagauccuuccugcccuggcucuucugcucacugcgaccacccuugacuuugugaucacugauaaccuucaccuucucuaaucuaaaucccaagcuucucacucuugguccaccaccucccagccuuguccguucugaacccugaacggaagcugaauggaacccugaacggaaggguucugaagcuguucagaacccugaauggaagcugaaauaucaaugggccauugcuuuucacaguccucugugaaagauuacuggccaagccagcaucuggagaauuccugguccaccaccucccugucuggagaagcuggaacagccagcugcaugagcaugugacccguguacucacaggcccugugcccugagcucgcuguuuuaauuuuaucuuugaauuuguauuuuugugaauaaagcccuaugagcuaauggagcaugcucagggaacuuggggcuuuagcucaggcuggauuccuccugcugccuccccagucccugguccccugagaacuccagccccaucugaccuucccuucccugucucuaugcaggggucauugcuacccucuaucccuggaaaggauguaggcacagggcaguucuagguuccagcuugggcaccgcuuaacaucuugguggugcagggaucaggcugaugauaccgugguuguucugugggcuacugggcagggucaagccacucccacccugauccagguaccuaaugcacccgacacagaagcggcaguguccuuggggucauccauuauccauguguuggaggagugggacccuagggaagaugcuuggcucgacuuccccaccccuagccagggcacaaucagagguccaggggcuggugggcacaaugccaagucgugaggccuccagugucugcgcucacugucccauaaauaaccacaguaauaacuagcaaaucaaaaacauugugauaggucgagagagacagcauguggaagaaaggaaaaagcuuucuauuuuaguaccuuuaacagugcuuucuguaugcuuuaugaacaaggagccugcauuuuuauuuugcacugggcucugcuaauuuuguagcugguccugcccccuaguagcucaagucagcaaaucuuugguucaucugaguccacaguccgcugacccgcccuuuuucacaguuccuccccugcccaugugcucacuucccuccuuacccagcuuggcgcacucccucaagcaagucuuuggaugcugacaucccccguaaacaacccuucugcggccugguuugauuuuccuuaggagacaugcaaguucuauagcacuguuucuugcuggguauggaggaugugcuauuuuguccauugcauauuuuuuaaagaaaaugaaagguuagcauaacuguuuccagaaggcacauugaaucacucaguugagucccagccaguugcugcaauguuagccuuugaagcaaacuugaaccaacacaggaccagccuagaagucccagccuccagaaaugaugcaguggauucugcagauucagcaacaacaauauuuuuguaacucaagagcacuuaguaauuuucaaaggagagaaagaaguaauugacuuggcuuauuagguugaaaaagaguugccaacuuuuucuuugguuuugauguuauugguuuuuuuuuauuuuucuuuucuccaagcuucagggaaugagauugaaugagcacucaagugcuacuaggcagaacccugaauggaaggaagcugaaauaccgaugggucauugcuuuucacaguccucuaugaaagauuacuggccaagccagcaucuggagaauucuaggaacgcccccuccucuugcagcaguauaaguuugcggggaucaucugaccccauuggggaguuguaugaaaaaggggauuuauuggggacccuguugccuguuuggaucuuacuuacauuuaacuauugucugcuaauggauuuuuuggaaagcaaccagguuuuccguaaagaauagcuaauugucagagcugagaugaccauuggagaucacugggcucaacucccuaauuuuagaggugcuaaaaccgcaauccagagaagcuaaucaagugguucaagguuguagacugaguucauauaggaccaagacccagcccagauguccuacugucugggacaguguucucucagcauacguggagccugaggggguaaugugugugcgugugugugcauguaugcauauacacauagguguuuugccuaaguuuucacuucugccccaccuugguugaucuuggagaaugagccugaggcgcgcugucaaccugggggccucauucagcacaggcccaacuuuucugcccugggggaguuccagcaguuaugguucaucugugguucaguuauggaacucacaccacacauagugcccccaaaaccgaggcugcgugcacagaccuccccucccuucccguggugggccccugcuuggguucuuccuaaacuuccccuuugcccugcucuguguuauacccucucugguccccugucccuguggagugauccggggcacaagggcagcuguuuccccgcugaccucugugugcccugagcaucugggagguggggagcaggcuggugagaagaacaccuggaguggagguuggggucagggagggucccagucccgguaccacccccaccugcugugggaccugcaguccccucaucagcagaacggcuaugaagccauccugcccauccacaggguggugggucgugaaggcugcauaccuggcagagcgggagaagcucugggaagaugccggacacgcgccgugggagugauuucccugccuugcccagauucugcucccaucaccugaaccugccugucaccaccauggaacugcugugaccauugcuuuccuuuuaagcagauuagcagacaucuccugcuccacccugccaaacaaacaaacaaacaagcaaacaaacaaacaaaaaugugcaugagggaguauggacuuguagagucuuuucuaaacauuguuaggugcuuguauugggauccucucuuaaaaugaaccauauuccccaggcuuuggaugacacucaugguugcccacccuccaacuuccuucccugcuggcagagcccuggguuuguuuuaguuccaacccugaccccaccgcauuccugacucaggcaaauucgcaggguccaaugcagucaggggagccacguucccuccuccaacgagugcugaggucgcugcuugauuggauacugccgaugaccuacgaggaggagggugccagggcgcuuuugggacuuugcuuuucuggagagaugcuuccacagcauggucauggacacagucacgucuugaugugaugucuggaauggugguggccgucuuguggcugugagaacaggcugagguugauuggauggagggaaggaaggagccuuguucuugaugcugucugugagccuuugaguuaucagccugguaccacccagcccuuggacagauaucuacucuacauacuccauuuggaguuuuuuuuuuuuuuuuuuuuuuuuuuuuuuuuugucacuugcaguugaaaacacccuaauugauacacacaaacuauuuuuagugcuggucuguguuuggcccuuauggaagacucugggcugagcugcccauggugagggagguggacuuuguguuuucuuacugcucuguguccugguggcuuguuugugucucugcccaugagacaaaagccgagagggcaagggcagauuuucuuaaucauauguucccugcaccaagcucauaggagacacucacugaaugguuguugagagaguucucuuucacggaggcaauguuuugugaaacgaugcugcuuguuguugucuguugguuguaauaugcaugaacacuaagagccaucuuuaaucaugcugugggccgccucuuccaagguguuagcauuacucccacuaccuggucagcauccugccuauggcuaggacuuugcaauuuacauagauaugguggggagaccuggagcccauggccaggacucugacacccucacuggaucuguuucuacaucuaccuggauggccgucuaggacauuagaggauuugugucuuccuaaagucccucuguugagagacuucuggcucuguuaagaggacacuauuuagcauugugagucccugcaggcugggggccagugggcguuuuucuucuagaugcccccucucuucuucuggccucccaggcuuccugcuccugagauugugagaacuggccugugcugggcucacugcagaaagacugucguccccaaagguuuugcaccaaacuugagcuacaagaucuuuuagggggaccugagaucuccgccugggcucuaugagagcaggcauggguuguuuuugccccgucacugcagucaugcccacacuugcauuuucuuuuccccccagcagugugaggaucuggcaugaggagugggacucgcgugcccucuuucuucuccucuucccucuggccuuuucauccgucagugggggacagauguuugcccuguuuacuucuaggcuuacuguggggcuccagggagauggugaaguggccaaggagaggagcugccaccuucaagacggccuguggccggugccgcuuuaaagggagacucagaggugcuuugcuguggguggcgcgggaaccagccuggggacagcagugcagaggccuuggacucagagugcgugggccccgcggggcuucacggcgccuguggcugugcacuuccagccauaucugugcugcaucucuuccacauucccccauggagcugaugucuagacagcuauggaauuaaaugcucaauuaccgaguaggaauuuggccagcagagguauagcugcugaguagacagacucgaggugaggcucacggcugagaacaggccccaucuggcuuuggaaugagcugaggugcccgaugcuccugcagccaguggcuccuguggggagcuggggccgugacccccaaaaggcagcuugaccucauggaccaccauaaaucuggccuggucaacaucucugccagacaucauucccuugcaaagauuucugccugugauuggaauucuggaugaacauguacugggcgugugggucugacagcugggaagcuuguucucuuguuuagccaggcugcccaucaucuguaagccucaguauccacaucuuuaaaauggggggaaaauauagcucaacuccuaauggugccaugagaauacuuugucaccugccaggcaaaagcuuauuccuuucacagaaauccaggguuuacaaugugagaccccuccccacuccgccgcaugugucugcuugcuuuuuucugucuuaggguugcccuucaugagcuaggaaaugucugaguggaugaaaaccuaaacgagaugaucacugguggugcccauuggugcagccuuugccuaaauggcuacuuacguagccacauuuccucgucuguguucaggugaggacugguuccugggcagacugccuggguuugcaucacggguguccaucuugucgaagcccauguggucacccaagugugacugagccaggcuugcccacggggugcucugggccccauuuucggcagcaggcagcguccccuggaggccuggcccuccccgggagcauggggaguagcgccuaugggcaagcagccugcagccuccaucccugccugggggcucccccgccccagccucacagcuucuccaaaaguguuugucuccuugccgcauccucuaggccugagcucagacgguggaaaagaagagcuggaaggagaguugccuuucagucucucugccuucugaggucuccugagacauagagccugggccugccucccuuucuaggaggcgccaaggggugguaagaauaggggaugagugagaugugaauuaggauccccacagcaagcccugccucguaacuuucugauggguuuucaauguguggugaagcagacgccugcugggcccccuuccugaguugaguuugaccuccugccuccugucuaucuccuugggcagccaggccaccccgcuccauuaaccugugccaccccaucccuuuaccugucgcaagcccagcccugaaggccucaaaggccuggucuuccagccaguccagggccugaagggauggcagugucccugguggaccuccccugguguggccuagugcacaucccagcccugccuccugccccgccugcacgccaugagugcugaagucaugccuggcaggggcugcuggcccaggcccagaguaaacacacugcgcugagcucgcuggugugcugcuggaugcugaugagcuugaggagugugggaagugagcauggggcugaguagagaugcggcaggccugcaccuccccgcagcugcccugcaugcuccagccucaggcagccacacagggaaagggucacccacugucagggcagaccuuuaccauggcugggugacacgggcuggcuguggaaagguguuuggugguucccgcuguuggauuugcacaggcccagaugcucacagcaaaaccaacaccuagauggugcuuacaggagccagcggguauucaaagagcuguucagaucuuaaguugcuucauucucacaguggaccauugagguagcuguacguuagucccauuuuccagaugagaaaacugaggaccugaguggucauaagcucaggcccucaucuaaaucacgcagccuggccccaggugugugcucuugaccauggacagugcucuccugguccucuugguaucugugaucugagggaccuuccuccuccucagucucguauagucaguuuuaggucuuggacucugucuucauaucccuuucucccuucgugagcuuucucacccagcaccuuccuuauuugguguguguugggggauauuugugguguggcguggcacuguguaguggaugagagagucuguuuuuccgaucccagucccagguuucaaacccugcucugucucgagucacccagaaucuuggacccucaguuuccucaucuguuaaaugggcaugguggucaccccaccucaucagcuagugucugcuccaucccugguggaggagaugacucaaguaaccccuggguuccaccugccccaccccacugguccccuggcucuuucuuuguugagauagacgaaugugaggcucuggaguugcaguucccacgagggcugggguggcugucugauuucugggccugguccauguuguucagggcagcugcucguucuaagugaauaaaggcugaaggaacucgggaggucugcucggcuccgaggaaggcagagagggaaagggccccgaugccuucccugauagagcuagggaggcccuucugugguuccccccagcuccuuggccugggugacccuggagcuggcuucuguuccauuuuguugugcagaguuguuugagacuccuggcuuugccuggccuuugugggacgcuggagaucagggcuucuggaguuggccaauuagccugcccagaccaggaagcacagguggcugacagagggccguuucaggagaggagagacagccuaccuauucggucuugcuguccccaugcuccaucccugccccugaccaguguggcccuguacucagcauaggcgugcaccugagucaguacaguucccugcccgcagagcaccccaaauauuccaggccucaggacggaugugcacaugaugagucggggcagguuucacugccuguagcuugggauccuucccuggggcuugguucucuagggccauccccagcagucucaccccaaacccuaaauucauguugucuuccucugucucuuggccucaagguuucagagugagucugugcugauagcuucaagaugugaugagaccccgacuuggccuccaguuaccuccccacgguuuccuugguguguguguggcuucaguguucacuggcucccgcacggcuugcaauguguggauuacgggugggagggaaauccaguccugcccgcagcaaagggauguuaguugugagcucaguuccccaccgggccugguguuuccaaauagcccgucacugucccugcuugguuuuccaugauaucugugccuuuaccuauuugguuaaauuaaaccaacucagcaacgccagccauugugguuucagggcaagcugccuguccugcugcuuggccgcuccucagagcugcggccgggagaguucguggucgccaucggaagcccguuuucccuucaaaacacagucaccaccgggaucgugagcaccacccagcgaggcggcaaagagcuggggcuccgcaacucagacauggacuacauccagaccgacgccaucaucaacgugagccucugucccucugcggguggggauuggggcagaguuuugccagggggagaggagucagcauaggucuuagccccugacuuuguuguagucugcgugaagggauggaacuagaccaagccauguggauucuagugccagcagcauggcaggggucacauggcggggacggugacaccggagcagguggacagccagccuccucccaggaggaagaaguuguauugggugcuuuagggugauugcaguuggcuucugggcuucagagagaaaaucucccuguuuacggcaccucuaaaacuuucugaaaauuguuaaggucauuuuuuuccggcaaaauauuagguuaaugggaaugaaucucagagaagaaucgugccccccacucuaggcaccgugcucaggaaacgaccaggcagggacauagauugaaccauguuaugacacgauuuguaaccuuuucauuucuguuuaauugcaguauggaaacucgggaggcccguuaguaaaccugguaaggucuuuuaaaccuauguuaggucauuuguuuuuaucuauguauacgcuguuuuuuguuuguuuguuuguuguuuguuuguuuuugaggcagggggucuuuucaaacauaagguugccaaaguguauuauaaauuccuuuaaaauggcucuguaaauguacugcgugcuugcaaaugacccuacggaucuuuucuggaaagaguaaggcaggccggaggugaggguuggaaauguuaugccagagaacacacuugugucucagaguuacagguaaacaccgugaaauucagggccaaugcaggaguaaggugaaggucacuaaaaaugcuggccagucaccgaaagcaccuccuccaaauuaaaucuccugggcugcugaaggagcuggcugggcucauacacauuuucucuuggccaggaauccucccuuaaggccuggcuggaaugaggaggaguuacccacccacaaagauaucacuuaagucuucccuuaaauacuugagcagaaaaagugaagccuuagaacacagaccagcagagcuagagggcagcucuggggccauuuauagagggcagcucuggggccauuuauagagggcagcucuggggccauuuauaggggcugucuuuagcaaggcccagugugauggcaccuccuagauggugccuuggcaucagguacugacaucucagcacuccugggaagugugcacuuggcagcuuucucuucccagcagaggggcagcugugcucccagcucuguccucugccuccccgcgcagcacuuggggauggaguggagauggcuuugcugguaaugaagcaugacagcccuaagcucuaggguuguuucccccugaagucagcagagucaucuuaagaucauuagacaugggagaagcaggaaggugugggcagccaccuaaaggaguuugagccuuuggaaacguauuccuugugaaacaggagcaaaucauaucgugcauuuugaaacuaucugugcuuaccgugaggugagcacccagugccgaccuggaguaugugcgauucuuccacagcugcgcguggcucgcgcugccuggguguccugaugccucucucccugcugccacggggauccccuccuugcaucuccccacuucgaucucugaaauagcucagggacuucuuucaggcauauucucucuggguguguaccugccgguaaagcuucacgauucaguaagccguguccuucuugcuuuucaggacggugaagugauuggaauuaacacuuugaaagugacagcuggaaucuccuuugcaaucccaucugauaagauuaaaaaguuccucacggagucccaugaccgacaggccaaagguaggcaaggcccacacagcccuggggacuccggagauggggccugaagcucagcugcccuuugggacuuggggaagggaaaagcggcagccccuaggacuagccaagccgucucugauccagaagugaacgggaaugcacauuacuaaaucccucgcagaaggucacagacauuucaccauuuuuguccucugaucauggcaaugucacuugagucagucuaauauguaccaggcaugauccuaggugacuuguguacauuauuucacuuucuuuauguaugucacuuaauucuuuugcccuaucaguuaggaauuacuagucccauuuugcugaugagaaaacgguucagggagaucauucugcaaacguuuauugccccaucugcucuaagucaagcagggagcuuggcaguggacagcucaacuggggccuggggcucaacaggggccuuugccggugugacuuuuauguucuguugggggaugggaaggcugacaguaaauaaucaaacacauaagauacuauuagugcucccaagaaaacggaucaggguggccgucaagggagcgacuggaggggcagcugguggagaugguguggccaggaaaugccuuccaagcugaggucugagugaggaggaaccagcgggcagggauguggggggaacacuccagaaggaaagacagaggacucagcauaguugagugagcacaaggccccugaaguggccugagggccggagcacagugacagcauggaguuccccgggguggaaagaggccaaggccgggcgagcaggcucacagcaggccguggugagggaccuggguugcauccuaacgacauuuaagaacagggaaguuuaugaucugauugaugucacugaaaggacacucugauggcugcggggagucugcuggagggguugcuggaaguuggggaccgguuaaggggcucucccagccaucuggaugagacaugcuggggucucagacaagggugguggcaguggaggugggacagaggggucacauuccagauauauaugggggguagagcaagcuuggggaagggccagcugucaggaugaggccaugaggaauuaagggucaugcccagguaccugaccauuaauugaaacaaugggacuuucccaaggucccccagaggggagggguccagaccaggauuugagccgcaaccucaguguacccuucuguggcccuuccugcaaccugggggauugggcccccggccccugguguccccagcacccccaccaacugggcugaccuucugcugucccuuuguugucucaccaggaaaagccaucaccaagaagaaguauauugguauccgaaugaugucacucacguccagguggguaaacaggaugcgugucugugucuuaaauuuuaauaaaccugaacuucagaaggugcucacgggcaccccugaaagagaaaccuuaugcugccuuaagacgucucaguuucugcuuauaaugaaguagcaucgggaaagaggacaggucauuagccuuggccccuuuguuugguuuuaaccuguguuuuugcauucugagcugguuuucuucacuggcagcaggcccuccgguguagaagguucugcccuccucuuugaaggcaggccugaacagugugugcgugguggggcuguugauucacucuggcucacgucuuccuuaccccacauucuguugaaacccacauuccaggagggccccaagccccucccgcagcucuaggcacucugcuuucguugcucugcagcucgugggccgcggcuccaggaaugccagggcagguccagcgcagggaagugaaugacugaugugcuuguuuuccccgagcugguggaauugcggccugugguuggcaggcucauggcauccugguguucuaaacuggaugaaaaauucugguguaaucucaugaguccugguaguagacucaccuggcauggcuaaaacugucagagguaaaguagguaaagacuagaauauaguaacagauagauuaauguguucauuacuaugaugaauuaaugauucacucacugugaaaguauuaauauauuuugauacauguuaugaaugguggucccuuucuuagcacuccagaagauggagccauuugucaagguuaaaguguccccucaguuguuugccuuuggaacuacgagguguagggaaagaugguaagcccuuggugcccagcuuccuggguuccugucccugcucugauauguccugccuugugaccuugggaacgauaugaccccugagugccucaguuuccuccucuucaggauagggaugacagcgcaggugcuucugauguguggccaggcucagaucagggagugguggcaggggucaccagccacagugaugccagccacuauguaucacacguacugggccaggugccuuacugggaugaucucaucugauccucacaacucauguuguaggguacuguuauuauccccauuuugcaggugaggaaaugaaggcacagagaaguuaagcaacuguccgaggucacacagcuagcaaauggccgagcuagggcugcaaaccaggccaaccacuguacuuuacugacuccuuaguaauagcuacuauuaauuaagaaauaauaacaaugaugauggcugggugcgguggcucacaucuguaaucccagcacuuugggaggccaaggcgggcagaucacuugaggccaggaguucgagaccagccuggccaauuugugaaacccuguuucuacuaaaaauauaaaaaauuagccgggcuugguggcaggcaccuguaaucccagcuacucggguggcugaggcaggagaauugcuugaacccgggauauguagguugcagugaacugagaucguaccacugcacuccagccugggcgacagagcaagacucugucucaaaaaaaaaaaaauaaauaaaaaaaauaaauaaauaauaaagcacuuuccuugcuguuaccaaguaaaucuuugacucugguagacaggcaauuuuaauuuuaaaauaggaucagaauuccuggaggaauuuuaccuuagaccuaaggagaagacgggaacuggugagagcugaguuuugcgugaggaaggccugguguuucuucacacuaacacgggugcuuuuucucuggagcagcaaagccaaagagcugaaggaccggcaccgggacuucccagacgugaucucaggagcguauauaauugaaguaauuccugauaccccagcagaagcgugaguuggagucguuuucucuuuucccaauauucuuguuguuccuguggggguagcaggaagagggagcgcuguuccuuuucuacuggcucagaugauuauguugauccuugacagacguggucggacguugcuugucauuccugcuggccaggccuuccgaccuggcucggcucgggacucauccauaggagggugccuucugucuucaaaaguccuugcuccacgaggacccuccagauggacagagcaauagcagacucguaaugagucucugagauggcccggcuggccagagagaggguuucaggaacaguguccccaagcccucacuuggugguccuuuucuaggcuucaggacccuucucuuccuggagucuuccagaaugucucugacaauuaggcccauaccugucaacaccuccagaaaaauaacccaagugauaucaaaguaacaugacaagaaguagcucaaccauccaucaggguuuguuaccuguauuggcggaauauccagagaaaagugcgagaccagggaccagcaaaugugccuugggggcuggaucuggcccacugccugcuuuuauauggagcugugggcuaagaauaguuuuugcauuuuauuuuuauuuuuacuuauuuuuuauuuucauagguuuuugggggaacaggugguauuugguuacaugaguaaguucuuugguggugauuugugagguuuuggugcacccaucacccaagcaguguacacugaacccaauuuguagucuuuuaucccucaucccugucccagccuuuccccuugaguccccagaguccauuguaucauucuuaugccuuuguguccucguagcuuaguucccacuuaugagaacauuuaaaugguugaaaaaauccugaaauaagaauaguauuuugugacauguuaaauuuguaugaaauucaaauuucaguguccacuguaauuugguuuaugacaucuaugguggcuuuugugcuggaacagcagaguugaguagcuucaacagagaccauauguacugcaaagccuaaaauauuuccuauggagcccuuuacagaaaaaguuugcagacccuugugcuagcccaugaaggaccaugacagcguuuugacgcugagcuauauaagagcuacaguuauaguggcaaccacacaaaggaagugccucuuaacagaaacauuccgcccaccccuauaggaacugcauucugaguugcaauacccauuauaagcaaguuggccagauaguggccaacuaucuggcagauaucuggccaacuacguggcagauaguaccugguacauccuuccccacuuuggggucaaucuugaccuuugaucuccuuggggucauaaagccacacaaguguuaguaggcauuucuacaguggacacaauggaugauuuagccuaaaaaucucaaaaggagcccagcauccuggcacaugcauguaaucccagcuacucaggaggcugaagcagaaggaucccuugagcccaggaguucgagacuagcuugggcaacaauugagaccccaucucaaaaaaaaaaaaaaaaaaaaaaaaagaguggggaaaaaagaacauuauuaaaaaaaaaaaccuuaaaaaguaauccaaucuaccgaugguuuauuuuuuauuuuauuuuauuuuuuuugagauggaaucccacucugucacccaggcuggagugcaguggcacaaucuuggcucacugcaaccuccaccuccuggguucaagugaaucucuugccucagccucugaguagcugggauuacaggugcccaccaccaaaccuggcucuuuuuuuuuuuuuuuuuguaauuuuaguagagacggggcuucaccauguuggccaggcuggucuugaacuccugaccucaggugauccaccugccucagccucccaaagugcugggauuacaggcaugagccaccgugccugacccacugaugguuugaauuauucuaaguucgccaccguccaauccuguuugcucugggcuuuuagguucuaagcugugccucuguccauguaaagucagaccaggaggaauggaaacacgaaacauugccauuguguuucccuuuguguugcagugguggucucaaggaaaacgacgucauaaucagcaucaauggacaguccguggucuccgccaaugaugucagcgacgucauuaaaagggaaagcacccugaacauggugguccgcagggguaaugaagauaucaugaucacagugauucccgaagaaauugacccauaggcagaggcaugagcuggacuucauguuucccucaaagacucucccguggaugacggaugaggacucugggcugcuggaauaggacacucaagacuuuugacugccauuuuguuuguucaguggagacucccuggccaacagaauccuucuugauaguuugcaggcaaaacaaauguaauguugcagauccgcaggcagaagcucugcccuucuguauccuauguaugcagugugcuuuuucuugccagcuugggccauucuugcuuagacagucagcauuugucuccuccuuuaacugagucaucaucuuaguccaacuaaugcagucgauacaaugcguagauagaagaagccccacgggagccaggaugggacuggucguguuugugcuuuucuccaagucagcacccaaaggucaaugcacagagaccccgggugggugagcgcuggcuucucaaacggccgaaguugccucuuuuaggaaucucuuuggaauugggagcacgaugacucugaguuugagcuauuaaaguacuucuuac

SEQ ID NO: 21434 - RNA, 20126 nt, Homo sapiens
ggcgcccuauaaguacugcggagcgaggcgcgcgcccggccagagagcgagcgcgcaacggcggcgacggcggcgaccccaccgcgcauccugccaggccuccggcgcccagcgccccacgcgcccccgcgcccccgcgcccccgcgccccuuucuucgcgcccccgccccucggcccgccaggcccccuugccggccacccgccaggccccgcgccggcccgcccgccgcccaggaccggcccgcgccccgcaggccgcccgccgcccgcgccgccaugggaguggagggcugcaccaagugcaucaaguaccugcucuucgucuucaauuucgucuucuggguaagggcugcgccgggggccggggcgggagggggcaggcacacacuccacguugggcaggucccgcggcagcgugcuaggccccgcgggcgcagcgcgggccgcgaaguuguggggccaccugugggcuccaggagcgggguggggggucgcccggggccaccgcgccccccgacauuggggcugagggcugcgagccgaguuucggggccucugugcucgggggcccaccucugcggccgggccggggcuucugggggccgccgggcaguucccgcugugguggugaugggugcgguggucgcgggucgggacccgaguacccggccgccccucagcuaaggaggggccugcgcgggucccuggccgcggauuccggacugcugcuucgcggggacgaggggggggcucgcgggcgggacuccuggcgccccgcccccaugagcucaucaagagccgccgccccuggaugguggggcgggggcgcacacuuugccggagguugggggcgauccgccucacucuuuccccagcccagcucacucuccaaucugcggucaccacccgagaccuuccugggggucgcgccuaaaaggagcgcagacucccgccgggauggcccagaagcuggggugcgcgcacccuggccgucccugccugggagccgaucucccucuccucacccagacacguuccagcggaggccuccucccagaagggcucuggaggccucgcaggaguggggaucccgcgguucugaguuggcacaaggaagagaguggcaccaggggccuggaguggauggcaggguccgggaguggggccgcugcuuugcaagaggggcccccacgcugggcaucuuugggugccagcguggguggaggagggucuuuugcugagaauggcuuucuccugaccgcagucuuugcugcugggaagugacugaugggcuuucgccuuuuguuuccauuuccugucgguguuagaauuggggaggggguggaaaucccuucuuggccuggaaggacuggaguggguguccauggccgcggccuccccguggccacgccccugggcauagacugcaagccccuccccgugccccccaggcugucacccccuucucguggaagacucggcugaugucccaguggaccgaguguuucucaaguugaggcagggagggcaaacuuuuuaaauggccccuggagccagugugugggaccagagacaucuguuucccaucuggacggcugaggaucccagugcggaugauuauuuggagggggaaggacggaggcugaacugaacucucagcugggagaugaguggggcagucacaucccaccuuccccaagccgggcuguucugcacagccugcuugggacgcuggugggagucacuguggccuucggcacugcccuggcagugggggcagcuaggccauuugggaggggcucgccuuccccaggcccggcccugggaccucagccguugcuuagugguggccugcuucagcccaggcaugugggagaggcaccagacacaggaugucccucugccagccccugaagccccguccccugacgaggcgaguguggaccugggggugggggcugagggagacuguggaccugggggugggggcugagggaggguguggaccugggggcaggggccgagggaggguguaggccuggggguaguaggggcugagggagaguguggaccugggaguaggggcugagggaggguguaggccugggggugggggcugagggagaguguggaccuggggguaggggcugagggagaguguggaccuggggguggggguugagggaggguguggaccugggggcaggggcugagggagaguguggaccuaggggcagaggcugaaggggagucacgggaggggacuucuccggagguggauuuuugcucucuggacggugugucagcacugggugagccccuccugccugcccaggcugagaggucucccuggcagcccccugggagugucgccagggcgggccuggaaguuucccaggcagcugggguggagaccugacacaucccaagggugcuuguuauuaaggcucaaggaaaugucucugaggccucaccgcuccucuccccagggccugcucccugcaaagcauugagaacugaguccguccacagucacuguggacccacccauccacuggggcucagugguagccagcaaugccaggcugggugaggugggguuggugggcaccacccugguggaccccccuccacccuggugucgcaggguguguggcugagagcacagugccaugggcuugggccuccuugguggaguccccaacacacugcucugguccugggccucggccuuccccgucugcagugggggcccacagugagccuaccuccuggugguguugguggauuugcugacaugccugaguguugacagggggcuuggugcaggaagggcucagggcguggguguuggccagggguccaaagggaccucugccucagagagcccagcccagacaggcaggaugugcaguggggaaggggcugcgggaacccugcaggguccagaaggacacagugcaguccugugggcucuggggaggcugguggggaggagguugacaauggauaucuggguggggcacuuguuagaaguuccauuuuagagaggaaagaggccuugccugugggagaaggcagcugggguagccugaccucuuucccaggaaggagcccacacacacacgcacaggcacucacacacacgaaugugcacacacacacacucccaccuucacacacacucacacucuugcugucucccuucccaagccaaggugcgagggggaaggucugggcagcaugcaccugcgcccugaccgcuuugggggccagugagaacugggcucccugggugcgcggcgggcccaagcagggaggacauugcagaugcccuggccaagcagcguggaaauccugucccuugggugggucucggagccuccaucagaggcggcuggcaccugagacccaccugcugccaggagcagggcaggagaguuugugucccgggacagggaacuggccugugggagccuugccuuccucaucuguguaauggauauaagagucuucuccucgggggcuggccagggaguccagaagaggugucaccaguccccgcagggagaagagcggugucccccgccugggacuggcugcucccccaagcuaaugcagcugguagccaccucccaguggcagggcagccaaacccggccgggaaagagacugauuagaagccucgcucacggguauuucucgcuuccagacagcacaugacugucauuuggcacgucuuucgccguccuuccgggagaggggcugcaacccuggcaggcgcugugggggagggggcuaggacauccugugccugguuucaccaaguggguguguggacuuucccuggcucccccaggcugucuggcugcacagcuuuggggaaacggccacugggucaagcgggccgagaagaggaagucugugguuugucucugcuacagacuggccccagugaggcuguccagcagugcagggcacagagcaaaagcagggagguaugggccuacuuccccggucgccccuguggcuggcuguggcucugccgggugcugacaagucacucgcccucccugcggucaccagggugcaugcccgaaagcccuccauucuuuccuggguuugaggguccuucuccugcacccaccccagcgcccaguucagcucaacuuucagaaaucugguucacccccaaucccuuucucauaacugcuuccaagcccagacaaggagacagaccccaaaagaucccuaccccuauuuccgcaccugaaaucgcaccacgggaagagcuuugcucauagagucaauaaggcuuagaguccaggcgccugugcgagggagcaggucaucacccuuguacccaccgugguuuuagacaggacccugagguugggguggggcuggggcuggagaggagccaggugcccugccccuugcuugggccccgugucccugugauccaggcugggcgugcuaugggugcugggugauauuccagcccugcagguguccgccuuguucccagcaccccucugggcaagaagaaccaggcucucccagaaaugggcuucagugaucuccacuuccaagucguccccaccugccuuguaggacacagugguaccugguaugcugggcagccuuccaggaaccucuggacuuacucagugucccccagcccuacacaccauucuuuguguuucugggcccaaacuaagccccccaaccugggcugcagagcaagugcugaaucaugagagacccuugaggguccuccagguaggcccccagugcuggaggaguccccucaggcagggggccacgcccaaggguguggaaggucagcuggcagccggaucucacuuuuggggcuguaggcuuccugcacuggccgccaaugccauggccgugggauggccaggauaaggcaucugccccccacccccaccccccgcacaaggucuuugagggcugcgggcucaaggaguuggcgguagggcugggggaccaggggcacagagcuuguaagcgccucucuccaggauguggguggcccagcaggggagcuuugagaguccaggugugagauuccaaaugcuaggggccugagaggagggagccaccagcuuggccagagccugguggaucacgcccccaccacgccuugcccuucucucuggucaugugcucucccaccacguuuggaaaguuacugcuucccucuuccucagccccucgggcucccaguuauggaaguggcgugauucagagaagguaaaggaugggagggagagggcugggugaugggggaccccgcagggcgcccugugcuguuacauggagcuccaggaucagggcaggugggcagccugggguccucacuucucuccccagccaggccaggucccucacagcccugccaggagcaugauauccgcugcggugcagaacuaaucucaaagcucaaacccagguaacaguguagguaaaacagaugacagggcaugagacucaccccaggacaggcgaaggacccaggccgaugggggcccagaacaguccugauccuggagcuccuucccgagugggaccccagggguuuccgaggggcuuagaguagggcuuagaggcuuagaguagggcuagggacuuccuggcuucccugccucgggaacagcugguccuggaaggggcuugguccucggggcacuggugcccaccaccccugaugccugggagacaccagcauccucugagcaugugugcguccuccuggucccgagggaagugacuccucacaucccccagcuggcggggccagagggccagcauccucgccugacaccuauuuuuagaugcugagacaggcggcuuccucggggccaggggcccugugaguggagcuuccgcuuccuggccuaggagagaauuccugcuccucuucccuccaugcugccuuuucgccccuggaggccacaacggggucagaggggcagcugcucaccaccuaggagggccugagagggcccuacgucacccagggaggagucuggccccguccccaaccuccacacccaggccuggcacugccccuucuuggugggcagagagugagggguuggccugcagggacccaggcuggaggggccguucaccuccggcccccagcgucccuuccuggaagcaccuuggugagccccuccccuccuucacccaguaucuccagggguacuuccuccuuuccuuccugccucagggccucacuguccuccuggggagggugucucaggccccagcaccucccaguggcugagccgaaugggcacuucccgguguguuucccauaugugcagucccuaggugucggugagcaggcacagagcccgcagcguggcccugccugguggacccccuccccaagagcaucaagggagggccuggacuagagacacacagaugcccagccuguacguaaaggcgggugagcugauguaccaucguccucgucccccacuggggugccugggcaggacuuggggugaccacuuggcccgucuggguggggguaagguauggguggggcgaccagaucccugcccuuuccugcagcugugggggugugugugcuggccuggagagcucccacccgaaguucuggcuccuggcuguccggggccugcgggggcagcgagcagcuggcauggguaggggagcugaccuaggccugcccgggcagcgccugcugccuuuugcucccuuucagcugcuucuuggaaacagcggacaggcugggcaggaacccagugugcuuggcagccccccuuuuaaagucgauucuguuauuuauuaauucccaggaaggagaaagaaagaaacaauccuucauagaguacaaacacugcuuuuaguagccuugcaaggagcccuccaggaaccccacagguuaccugggcuccauccugagagccacccuccauccccaauccccagcagagcaucuugugggguggggcggcuuguggggcggggcgccuugggaggcggggugucucgggaagcggggcgucucgggaggugggguggcuugugggguggggcauuuccugggguggggcgucucguggggugggacagcuugggggguggggcaucucgggaggcggggcgucuugugggguagggcggcuugugggguggggcaucuugugggguagggcggcuugugggguggggcaucuuguggggugggacggcuugugggguggggcaucucgggagguggggcaucucuggggcccggccacuugggaggcggggcauccugggggcggggcaucucagagggcgccuccggaggcuggaguaucuugggaggugggagcagguggcagagaggcuucccacaggugagcuuugagcagggaggugccuguauggauggcucuguggggagaggggugacaggaguuccagauuccggcacuuaugaaaccucacagugauggagagccgagugcugcugugcaggcuaaguugugugcaugucagcuucugcacuuuuauuuccuuguuuguagacaaggcagagagaagcugagaugggccugaggucgccuuggugaaaggcacucagcagccagggccuugggcugcccucccucaucaccgugaaagcgggacucucuuuuaacugacaucgggcuccauaguuacuccaguccuaacuuugauggauccuaaaagugcacuucuaaggacgcggcuucgguguuucccaugccgcugcuugccccugggaagcguuggcucugccucggaagaaguuagcgccaagauggcagccuggggucuuuggggcccagaagaaacacuggccccggggaguucagucaucagggacuuaggaugugggggcuuuucaaacagcuuuauuuagacgugauugacacacaguaaauacagauguuuaaggguacaacuugguaaguuuugacaaauuuauacccccgugaaaccaucaccaacuccccaggugccccuggggcccuugggaucucugcuuccugccccuccuccccgucccagggcaaccacgggccgucgcugugggugcacacagcaugcauuucuucaacaagcggacucagaaggcacuugcacaucguugcuguucugccucuuugcuucagcaugauuacccagaggcgcacccgugccguggccugcccgucgucuaugcacccgugcuguggcgugcccgucgucuguguggcaugccugucugugcacccgugcuguggcgugcccgucgucuguguggcaugccugucugugcacccgugcuguggcgugcccgucgucugugcacccgugcuguggugugcccgucgucugugcacccgugccguggcgugcccgucgucugugcacccgugcuguggugugcccuucgucuguuccuuuuauugccgggcaggguugcacccacaugugcaagccagcgacggaccccagguucacccguucaccggucagugggcauauggguuguuucaguuuggggcauuuacaagaaacgugcuagaacauuuguguacaagucuugugugaaccuaaguucauuucucuuggguaaauaccugugcguggagcagcugggucauguggugaauguggguuucacugcuuaagcagcaguuuuacauaacugccaaacuguuauucaagguggcuggaccguuuuacagcccccguuguaugcgucccaguugccucccccagcagcauguggugugguuggucuuuuucguggcagccaguccacugggugcgcucggcauguggcugcagcuugaccuggguuuccuggucccuggcaagguggagcaucucuucaugugcuuuuuugcuguguguggaucuugcggggaagggucuguuccuguuuuuugcccaucuuucaaagauuggguugccaguuuucuugcuguugaguuuggaaagcucugcauacguucagggcacagguccuuuaccaggcucugccccaggucuuucggagagcaggugucuuucgcauuccugacucuggggaaccucuagcccugccacaugggguuuguuauggggcaggggcaccugugccuuucccaccacggggcuuggggauuuggugcugccauugcccucccucguagguggcccuaggggggucccuccgccuccguuuccucauccagaaaccggcagugaccaucaccaccauuguugucaccuagcuccagcucaaggucccugcugaaggucggagagcuuggcauggccccguuuguccaugcuagggcugggaagaccaaggcucaggugaggccucugcccagugccuggcacuccuucuugccccauuuuuccacccaggguggcucccgacuacuucugguagccucggggacaguugagguggacaggcuggcgucacccccauuuccggcugucccucccacccccuccuggcccagcuguucugcccuauuaaaagucacaugggcccucggguccuuccugguguuggcccaggcucuuucaggcccugcaggccaggaccagccuucccugcaacccucggcagaggccuggggccggggcuugucuaggggcagccuccccauacggcccuggagucugaacagaagccccuucccagagcacagcaagaagcugcaacguggccugaagucccaccauuagcagguuugggguuuaggcugagcuuugccaucacuaccuuucuguuaggacgguaugcccauuagaugggaucauccccucagcgcccaggcuagaggagggguggucccugcccagccagggagggcuggggguggaugggccucuacagagcagcuuccgagccaggcacgguuccaugaucagcucuguuuuauagagggggacacugaggaaccgggagccuggggaccuuccaguggccccacagcuccuguggcugagucaggguuugucaccaggccucuguggggaugaggcucccccauccaccugccccacucuguccuggaacagcucucaaaacggucucuggaccacaguuucaaaagaaaauaagcaauguuuucaaaggcccuggaggaagccagaguuaccacggcaacucucggccucgccaccuccucccgccaggcugcaucuggagccagcucaggagggcagcagggugaggacagccaggcucucuggggccaccccccagcccccacccuuccugccucuccugcacuguccacggcccucccugugcucccacggguauaaugggcacagaagaaccaggagcugucugccccugcaggauucuggaagccaggggccccuggccucccuggggccuugucaugugaggggcacacguggggucccagcugccacauggcuuccagcgcugcccgcagguguauguugggcccuuggugacucuaaugcaccuuccacucggcacagaagagcuucagucuggggccugggcgggggaaguaggcugccauccucgcuaaaccaaagugugaaaauugaguugaaacucccauaggagggcaggaggcacagcuccucagaagaaggucugagaaaccacagcccagguuguuguuucggguguguggagaaggugcucuggcaguccugcuacagggggaccaucaacagccccuuuggggugagagccccguggcugcuggcaccagcagccccuaugaggcuuauuuuauuuuugagacagggucuugcucugucaccgaggcuggagugcaguggcacaaucauaacucacuguagccucaaccuccugagcucaagcgauccuccugccucagccuccaaaggugcugggauuacaggcgcuugcuaccacgcccagcccccucuggccuuauuguuugccaggcccagcucaggucccggaggaggggagacaggagugugagggaaagggggaagagguauagagcccccagcuccuccacccacccgaacccucaccgaggcccuagacccuagaccggccugaccgggggguccucaggccggggacuugggugcaggccauggugcuggggccugaagcucacgcucugcugagcacagcccccugcccaaccccacccuggggcccugcuucccuggccagggccauuggaacaggaguggggcuguccaggugguguucuuggguccagcccucaguuucucuucugcaguugaccggcagcccugcaucugugguggggucggcgccuggugcuggugaggcaaggccucagcugcugggacaggaccugccuggcacccagcugguggcagagccaagcauuccgacucagcucugggagcagcugccuucugggcuggcauucuccgccagggggguugugcccucguggccccccccgggugccuccucaccuggcugauuucaucuccugucccccugccuccuccuccaggaagcccccagggccuggcccuccuugagaguggcauggaggaggaagaagacucgcccaggcccaugggagucggaugguggccgcacuuguggggcccugaccccauaggcuucuucagcacgcccuggccugggugaucccugccugagggcugugcacggcucaucugccagaccagauuuuaggggauucuuguacuguccuccuggagcagcaggggguaaagccugacccacccagacuguccagcaacaagggccuccugcugugggccagggacccuggaacugaccaauuguguccuagggacgcagaguccccaggcugcuagagggcuguggggcccuguuucaugccugaagcaggaagaaaccccaggagaggucugaaggggacccagcccccacccugucuagcagggaggagccucugcaagaggccgaggggugcugaaguggaggaggauagaggcagcaggacucagggucacuggucauuuauggggaucacacggcugcagugugcccugcauggugcuaggcaccagggacagcagaggacaagccuguguccucucccaccaccagagggcugggcacugccccuagggagagagggggccuuggugugugcagaggggggccuggggcacgugccuggccuggucagaugaucagagugggcugggcugggccuggucuggggcccagucucaagggcagaccccaccuggcuagaguugauugugugcacaccggaugacccggcguugaaggccucuccucucugugagccucauccccaccugccagacucccagcacagccugcuuccugccccagcugcugagcgacagcgcugggccggcuucugcgcgccccuucccccagcccaucuuggaaaccacagcagcguccuuccucccaagucccuucccagggcugacaucccacagcagggauguaucccacaaaccccgcaggcccuggugccuacagcuuggccugguaacaucaaauccuacccucuccuccuggcagcaaagauggggugcccccaccccagaguucucagcacccccagacagaagcagucccccagcgaccucagaacucuuggggcgcugccacacccuugcaggagggggcaguguuccugggaugcucagguccugguaucaccucuggccagauacggaaggugaaacuacagggcauccaauucaccuugaacuucagauaaacaccagauuauuuuuuuguaugucccgugcaauauuugggacacacuuacccuaaagaaguauucuguuuucaucugagaggcagauuuaaccggcgucccgugucuuccuggcaguccugcccuggagucacacuccacaggugcagggcagggccaggcuccaaguagauggcggccaaagcacccgccccaugcuccugacucccggggcucuucagggcauugcgaaaaccagcagcagagcugacaccuggucccugcucgggagccagcaaggcaggaggcugcuuaggccuugcguguggggugggcgcacucccugcugcagugcucuucguacaugugacacuguucccgcucuuucccagcuggcuggaggcgugauccuggguguggcccuguggcuccgccaugacccgcagaccaccaaccuccuguaucuggagcugggagacaagcccgcgcccaacaccuucuauguaggugagugcacauguggccgcagacgcauucagggagggcuucuaggaggaggcagguccuagccuuuuggauggggacauggagggugaaagacagucgggcauggcguguccgggcagggaggcggcccuggaaagggcucugggcacaaggguugagauggaggugggccuguggccugcuggcccuucuggucugagccagggcaggggguggcagcuaggccugggcagggacuguguggagaccuugcuuauuuuaagugugggguuauuucgggggaggcucccugagaaggguggggcuggaugccugggccacacagagcagccgaggcagcuggcgcuguggagcccgggagggagggagggauggagcucaagggauggaacccagugagggguggagacggggcaggggagggguggagagggguggagacgccccagaggcggugugacucagcugccccugcaggcagcugcaccuugcugccuuauuaggcugcgugugggggacugggcugcccucccugcccccaggagcaggagcaggagugauggaggaggaggaggggaggggcaaggccaggaggaggaggagggccaucucacugugcagagagcagcacccuuccuccuggugccccuggcagggcuggugcugguggggcucugggagcauuuguugagaugcuucuggccuugaaaggaggccccugggauggcucuguugcccucacaggcugaggggugggugaggugggcagccuguguguccccaguccucagggcuucccucagccggcaggugcccccaggccuggagcugcagggccaggcccccugccaguuacggaggcugcuuggcuugguugcugaaccagggccccaggaggccgaaauagccccacaccugcgccgucccaccucuuuguccagucaccccagggccaggugagggcccuggccacacagcgugcccguuccuucuuccccaugccccgcucaugggucagagggccggugcugggguccagauggugucaacagggauggucccuguccuccccagagacagaagccuguggcccacggaggguuucugggcccagccgauccuagggagggucccauggcccugcccauagguuccuggccucucucggggccguggugcccucacagguggugucaggaaggacgggaaaggcugcuugucccaggggcucauguggagaccacccccugcacgcagcuggggcgcuccugccuguguccucagaagcacucggcuuagcuuugcccaugugccugggcuguggguggcagagcccggccagcauccuccgaucuccaagggugcaucucuacuggaggccccuccugggccucuugcuccccgcuucccagaucauuaggauauuugggguccagaagggccucccagccauccugggccuuguccuccggggccaccaguccagccagugacaaccacagcauccccggccuggaacgaggcugcccccagcacguuccucguacuccuguccagggacaggaggggcugccccugccaccgaguccccuucuccaggaccuggggccugugggugugaggcagguguucuuggaaggggucacucuccaggcacccggcggccaaggcuuguggcuggagcagcucccgcuguggggucggcgucgggccccguguggccggagaggagcugaagggucacuuagcuucgggcuggggcgaggacaggggacaccccagagagguaugccaggccuccuuccugcgccccacucucggcagaagcagaggucacaggcugugcugaggccccauggugcugcccccaugaugccagggugaggcuggcguuggaagcaggugucugaccugcauggugucaccguggccacaucagagcuccagccccagagccgcccacccucgguccuuggcugugguuucccugggcuggaggagccugccguuguguuggccacacgaccacaggaccugccacccccgacgugggcucugccugggcccccacuggacagggaccccuuggagcuccucuggccaccaaguccucgcccauuccagaaucggccuucuggagccucuugcugucccugaugcgggcugggccuugccaagggcuuuuuuuccugcgccgggaacaggguggauuugcugggcucacuccccucagagacgcugcgggugcgguggguuaggcccaagggcguuaagagaggaggcugggguggggcuggggccuggcagggggucuggcagcccugggccucccaccuccugucaggaccaaaaaaggcaacgcgccucuccugaccuguaccccggagugaacccaaccuugcaacccaggagugucagggccugaggggagggagaccuggcuccugggugccgugcccguaaggagguggccaccugcagggcauuccuggcagaggcuucaucuggccagguaggaggcuggguggccgagccccaaaucuggguguguucucugccuggcgguggguccugccccaggcaccuucuccucugggcuggcugggcagggacaaugggccuggcugcgaggagggggccugggcugccuucugcauugccucggugacgggagauggccccugccugcugagggauaggggagugggcaggcagugagagacacugacagcugucccgcggguacagggcccugucuggguggccaggcccaugucucgggcccacagugcgccccccacccuuggacggcgccuucucccuccccaggugcaugcugcccagccagggagcgugggggaguucgggagggcuggccuacacgcccugguccagcugucccagguggggugcugggcuucagcccucagcccagggccuaggaauccaacuugauccuccccacacagcagccagguucaaaugcaggucccguaacggaagugcugcugugcagcccagauuggggggcaggagccagcagggcccccccacccucuucucgcaccacacuggggaggcagcauugguuccaguuccgguuccugggcugcccucucaaccccggccuacaguggggcccacccugugccuucugaugccacucccaccccacgccaagucccagaggcuuugggagcgggugaaggcgguggguggcggguggcaggugcaggcggugggugguggguguggcagguggcgggccccaccgcaggugucaucccugcgaagcaccugucgccagcacucagagcgcucaugaggugcccaguccccauguggccuccuuagucuccguccugugucauggaagagguaacugaggcacagaaaacucaccaggccaggcugggaugugaggucccuugcugcucaucccuggcagucagcaacccuacaucuucccagcugggcggcccgugguggguucggcacccaggacccuccggggucuugggcuguggcgaguguguaggcacccaccuggugucucucuccccgcaaggcaucuacauccucaucgcugugggcgcugucaugauguucguuggcuuccugggcugcuacggggccauccaggaaucccagugccugcuggggacgguaaggcagggaggcgggccugugccugggccggggaggggcugggggcugcgucuggcccugaggagggggcagagcuggugcucagggcggagccuagaauucugggggagguggcuccugugcccugcuuuucccguuugguuuuuaaauuaaaucccaccgugcuuggucuccaucguggccaguuccuacgugaccgcuuuucuuugucaaaaaauagccacaaauauaacagggagcaagccucagcucugaggccagccucggcgucccgggcacaccgcccccugugggaagcccaggccuggcugugccauccagggccuggccaguccaggaagagggagccuaugcccgugucuccagugggggaaacugaggcagaucccauggcucccccuuccguggggagcaggaacaaggggguggggaagaucagucaggggucaugcugcugcacacgccucccugggggcugcagacauccuggacucaccagccugugaccccaaaccacacgccccgccccauccaccccguccuguggagccuggugccgcguggggacauccugggcuuugacggcuccucccugcgcugaguuuuagccucugugccccagggcuccacacaagccgcucacuccuggucaggucgugggcugguggcucccacuagccccucacagacacgccugcugggcaccuggguguguguccuugggccccgccuacagccugcccucuuuccucccucuggccacugcccggcuccaguucuucaccugccuggucauccuguuugccugugagguggccgccggcaucuggggcuuugucaacaaggaccaggugagccugggugugcagggacaggguggggugggugacgggggcacccuccucuccugucgcggguggggguugggcugacucauggcuugugggagcucuuugggcucuuccugggucccacuugccaggaggaucuccaggggcuuuauggaggaggcagcauuggggcugagcaccaggccagccucccgugucccagcacucccggggcagcugagagugcagaguccuuguccucuggggucuagccucgaagccacccugcccagggagagccugggaaaagugcguccgccuggggcggggcggggugggggcaaggagggggagguucccccugugcaugugaccgcaccccucccccagaucgccaaggaugugaagcaguucuaugaccaggcccuacagcaggccgugguggaugaugacgccaacaacgccaaggcuguggugaagaccuuccacgagacggugcggccccggggggcgagggcggggagcagggccccgggaacccggcggggugugucucguccuggaugaauccugccuacgcccagaccucaggagcaggaggugcccuugggaccuccaggaccccuggucucaacugguccucgggugggaaccuagugggccaggguggcccagggugcggaaagcucugagcagcgcagcugaggaggaagaaggcuggccccuggaugcauucugcaguggggagcgcugcguaccccuggccaccuccccauggguucccuagagccaccgucccccugggcacauccagggcugaccuugcaccccugcucucugcagcuugacugcuguggcuccagcacacugacugcuuugaccaccucagugcucaagaacaauuugugucccucgggcagcaacaucaucagcaaccucuucaaggugcgcgaggccgguggggccgcgccugaccccccgcaugucccgccccugggugggguccuaggggugggcaggucacacggcagccccacagggagcgaccacacuggguggcauggccccugucagggcugcucugcugggaggguuggggugggaccgcaucuggcccacgaggaaggcaggcgcccugugcugcgcauuccgggugaagaagguggaggcucuggggggugggaacucaccugcacccccagcuccacgugugcacucguggguguggacgccccugacagccuguagcuggcagggccugcaggccauauagugcccuguggaaguuuccugcugaggccucaguggaagucgucaucagugaugcuuuaggggucuagugacaccaaugaccgugaucucaguggaaaagggcacagugugucccaggcauuucgcguuuauguuaaaacggguggaagauagcaagccggcagaggccgggccgcugcacccgccuguuccgagguggguaggggguggggggcuguucccaggauuccccucuacgcuuucuguggugaccacggauuacugcgugacaacgggaagccgggagccgaggcccggucccugaccacgcgugccuggccaccccugcaggaggacugccaccagaagaucgaugaccucuucuccgggaagcuguaccucaucggcauugcugccaucguggucgcugugaucauggugagcgggcgggggcggagggccugcucucugggcugccccuuccgcggggccuugugcugacugcgccccccaccacccuccugcagaucuucgagaugauccugagcauggugcugugcuguggcauccggaacagcuccguguacugaggccccgcagcucuggccacagggaccucugcagugcccccuaagugacccggacacuuccgagggggccaucaccgccuguguauauaacguuuccgguauuacucugcuacacguagccuuuuuacuuuugggguuuuguuuuuguucugaacuuuccuguuaccuuuucagggcugacgucacauguagguggcguguaugaguggagacgggccugggucuuggggacuggagggcagggguccuucugcccuggggucccagggugcucugccugcucagccaggccucuccugggagccacucgcccagagacucagcuuggccaacuuggggggcuguguccacccagcccgcccguccugugggcugcacagcucaccuuguucccuccugccccgguucgagagccgagucugugggcacucucugccuucaugcaccuguccuuucuaacacgucgccuucaacuguaaucacaacauccugacuccgucauuuaauaaagaaggaacaucaggcaugcuac

SEQ ID NO: 21435 - RNA, 20126 nt, Homo sapiens
guagcaugccugauguuccuucuuuauuaaaugacggagucaggauguugugauuacaguugaaggcgacguguuagaaaggacaggugcaugaaggcagagagugcccacagacucggcucucgaaccggggcaggagggaacaaggugagcugugcagcccacaggacgggcgggcuggguggacacagccccccaaguuggccaagcugagucucugggcgaguggcucccaggagaggccuggcugagcaggcagagcacccugggaccccagggcagaaggaccccugcccuccaguccccaagacccaggcccgucuccacucauacacgccaccuacaugugacgucagcccugaaaagguaacaggaaaguucagaacaaaaacaaaaccccaaaaguaaaaaggcuacguguagcagaguaauaccggaaacguuauauacacaggcggugauggcccccucggaaguguccgggucacuuagggggcacugcagaggucccuguggccagagcugcggggccucaguacacggagcuguuccggaugccacagcacagcaccaugcucaggaucaucucgaagaucugcaggagggugguggggggcgcagucagcacaaggccccgcggaaggggcagcccagagagcaggcccuccgcccccgcccgcucaccaugaucacagcgaccacgauggcagcaaugccgaugagguacagcuucccggagaagaggucaucgaucuucugguggcaguccuccugcagggguggccaggcacgcguggucagggaccgggccucggcucccggcuucccguugucacgcaguaauccguggucaccacagaaagcguagaggggaauccugggaacagccccccacccccuacccaccucggaacaggcgggugcagcggcccggccucugccggcuugcuaucuuccacccguuuuaacauaaacgcgaaaugccugggacacacugugcccuuuuccacugagaucacggucauuggugucacuagaccccuaaagcaucacugaugacgacuuccacugaggccucagcaggaaacuuccacagggcacuauauggccugcaggcccugccagcuacaggcugucaggggcguccacacccacgagugcacacguggagcugggggugcaggugaguucccaccccccagagccuccaccuucuucacccggaaugcgcagcacagggcgccugccuuccucgugggccagaugcggucccaccccaacccucccagcagagcagcccugacaggggccaugccacccaguguggucgcucccuguggggcugccgugugaccugcccaccccuaggaccccacccaggggcgggacaugcggggggucaggcgcggccccaccggccucgcgcaccuugaagagguugcugaugauguugcugcccgagggacacaaauuguucuugagcacugagguggucaaagcagucagugugcuggagccacagcagucaagcugcagagagcaggggugcaaggucagcccuggaugugcccagggggacgguggcucuagggaacccauggggagguggccagggguacgcagcgcuccccacugcagaaugcauccaggggccagccuucuuccuccucagcugcgcugcucagagcuuuccgcacccugggccacccuggcccacuagguucccacccgaggaccaguugagaccagggguccuggaggucccaagggcaccuccugcuccugaggucugggcguaggcaggauucauccaggacgagacacaccccgccggguucccggggcccugcuccccgcccucgccccccggggccgcaccgucucguggaaggucuucaccacagccuuggcguuguuggcgucaucauccaccacggccugcuguagggccuggucauagaacugcuucacauccuuggcgaucugggggaggggugcggucacaugcacagggggaaccucccccuccuugcccccaccccgccccgccccaggcggacgcacuuuucccaggcucucccugggcaggguggcuucgaggcuagaccccagaggacaaggacucugcacucucagcugccccgggagugcugggacacgggaggcuggccuggugcucagccccaaugcugccuccuccauaaagccccuggagauccuccuggcaagugggacccaggaagagcccaaagagcucccacaagccaugagucagcccaacccccacccgcgacaggagaggagggugcccccgucacccaccccacccugucccugcacacccaggcucaccugguccuuguugacaaagccccagaugccggcggccaccucacaggcaaacaggaugaccaggcaggugaagaacuggagccgggcaguggccagagggaggaaagagggcaggcuguaggcggggcccaaggacacacacccaggugcccagcaggcgugucugugaggggcuagugggagccaccagcccacgaccugaccaggagugagcggcuuguguggagcccuggggcacagaggcuaaaacucagcgcagggaggagccgucaaagcccaggauguccccacgcggcaccaggcuccacaggacgggguggauggggcggggcgugugguuuggggucacaggcuggugaguccaggaugucugcagcccccagggaggcgugugcagcagcaugaccccugacugaucuuccccacccccuuguuccugcuccccacggaagggggagccaugggaucugccucaguuucccccacuggagacacgggcauaggcucccucuuccuggacuggccaggcccuggauggcacagccaggccugggcuucccacagggggcggugugcccgggacgccgaggcuggccucagagcugaggcuugcucccuguuauauuuguggcuauuuuuugacaaagaaaagcggucacguaggaacuggccacgauggagaccaagcacggugggauuuaauuuaaaaaccaaacgggaaaagcagggcacaggagccaccucccccagaauucuaggcuccgcccugagcaccagcucugcccccuccucagggccagacgcagcccccagccccuccccggcccaggcacaggcccgccucccugccuuaccguccccagcaggcacugggauuccuggauggccccguagcagcccaggaagccaacgaacaucaugacagcgcccacagcgaugaggauguagaugccuugcggggagagagacaccaggugggugccuacacacucgccacagcccaagaccccggaggguccugggugccgaacccaccacgggccgcccagcugggaagauguaggguugcugacugccagggaugagcagcaagggaccucacaucccagccuggccuggugaguuuucugugccucaguuaccucuuccaugacacaggacggagacuaaggaggccacauggggacugggcaccucaugagcgcucugagugcuggcgacaggugcuucgcagggaugacaccugcgguggggcccgccaccugccacacccaccacccaccgccugcaccugccacccgccacccaccgccuucacccgcucccaaagccucugggacuuggcguggggugggaguggcaucagaaggcacagggugggccccacuguaggccgggguugagagggcagcccaggaaccggaacuggaaccaaugcugccuccccaguguggugcgagaagagggugggggggcccugcuggcuccugccccccaaucugggcugcacagcagcacuuccguuacgggaccugcauuugaaccuggcugcuguguggggaggaucaaguuggauuccuaggcccugggcugagggcugaagcccagcaccccaccugggacagcuggaccagggcguguaggccagcccucccgaacucccccacgcucccuggcugggcagcaugcaccuggggagggagaaggcgccguccaaggguggggggcgcacugugggcccgagacaugggccuggccacccagacagggcccuguacccgcgggacagcugucagugucucucacugccugcccacuccccuaucccucagcaggcaggggccaucucccgucaccgaggcaaugcagaaggcagcccaggcccccuccucgcagccaggcccauugucccugcccagccagcccagaggagaaggugccuggggcaggacccaccgccaggcagagaacacacccagauuuggggcucggccacccagccuccuaccuggccagaugaagccucugccaggaaugcccugcagguggccaccuccuuacgggcacggcacccaggagccaggucucccuccccucaggcccugacacuccuggguugcaagguuggguucacuccgggguacaggucaggagaggcgcguugccuuuuuugguccugacaggaggugggaggcccagggcugccagacccccugccaggccccagccccaccccagccuccucucuuaacgcccuugggccuaacccaccgcacccgcagcgucucugaggggagugagcccagcaaauccacccuguucccggcgcaggaaaaaaagcccuuggcaaggcccagcccgcaucagggacagcaagaggcuccagaaggccgauucuggaaugggcgaggacuugguggccagaggagcuccaaggggucccuguccagugggggcccaggcagagcccacgucggggguggcagguccuguggucguguggccaacacaacggcaggcuccuccagcccagggaaaccacagccaaggaccgagggugggcggcucuggggcuggagcucugauguggccacggugacaccaugcaggucagacaccugcuuccaacgccagccucacccuggcaucaugggggcagcaccauggggccucagcacagccugugaccucugcuucugccgagaguggggcgcaggaaggaggccuggcauaccucucugggguguccccuguccucgccccagcccgaagcuaagugacccuucagcuccucuccggccacacggggcccgacgccgaccccacagcgggagcugcuccagccacaagccuuggccgccgggugccuggagagugaccccuuccaagaacaccugccucacacccacaggccccagguccuggagaaggggacucgguggcaggggcagccccuccugucccuggacaggaguacgaggaacgugcugggggcagccucguuccaggccggggaugcugugguugucacuggcuggacugguggccccggaggacaaggcccaggauggcugggaggcccuucuggaccccaaauauccuaaugaucugggaagcggggagcaagaggcccaggaggggccuccaguagagaugcacccuuggagaucggaggaugcuggccgggcucugccacccacagcccaggcacaugggcaaagcuaagccgagugcuucugaggacacaggcaggagcgccccagcugcgugcaggggguggucuccacaugagccccugggacaagcagccuuucccguccuuccugacaccaccugugagggcaccacggccccgagagaggccaggaaccuaugggcagggccaugggacccucccuaggaucggcugggcccagaaacccuccgugggccacaggcuucugucucuggggaggacagggaccaucccuguugacaccaucuggaccccagcaccggcccucugacccaugagcggggcauggggaagaaggaacgggcacgcuguguggccagggcccucaccuggcccuggggugacuggacaaagaggugggacggcgcagguguggggcuauuucggccuccuggggcccugguucagcaaccaagccaagcagccuccguaacuggcagggggccuggcccugcagcuccaggccugggggcaccugccggcugagggaagcccugaggacuggggacacacaggcugcccaccucacccaccccucagccugugagggcaacagagccaucccaggggccuccuuucaaggccagaagcaucucaacaaaugcucccagagccccaccagcaccagcccugccaggggcaccaggaggaagggugcugcucucugcacagugagauggcccuccuccuccuccuggccuugccccuccccuccuccuccuccaucacuccugcuccugcuccugggggcagggagggcagcccagucccccacacgcagccuaauaaggcagcaaggugcagcugccugcaggggcagcugagucacaccgccucuggggcgucuccaccccucuccaccccuccccugccccgucuccaccccucacuggguuccaucccuugagcuccaucccucccucccucccgggcuccacagcgccagcugccucggcugcucuguguggcccaggcauccagccccacccuucucagggagccucccccgaaauaaccccacacuuaaaauaagcaaggucuccacacagucccugcccaggccuagcugccacccccugcccuggcucagaccagaagggccagcaggccacaggcccaccuccaucucaacccuugugcccagagcccuuuccagggccgccucccugcccggacacgccaugcccgacugucuuucacccuccauguccccauccaaaaggcuaggaccugccuccuccuagaagcccucccugaaugcgucugcggccacaugugcacucaccuacauagaagguguugggcgcgggcuugucucccagcuccagauacaggagguugguggucugcgggucauggcggagccacagggccacacccaggaucacgccuccagccagcugggaaagagcgggaacagugucacauguacgaagagcacugcagcagggagugcgcccaccccacacgcaaggccuaagcagccuccugccuugcuggcucccgagcagggaccaggugucagcucugcugcugguuuucgcaaugcccugaagagccccgggagucaggagcauggggcgggugcuuuggccgccaucuacuuggagccuggcccugcccugcaccuguggagugugacuccagggcaggacugccaggaagacacgggacgccgguuaaaucugccucucagaugaaaacagaauacuucuuuaggguaagugugucccaaauauugcacgggacauacaaaaaaauaaucugguguuuaucugaaguucaaggugaauuggaugcccuguaguuucaccuuccguaucuggccagaggugauaccaggaccugagcaucccaggaacacugcccccuccugcaaggguguggcagcgccccaagaguucugaggucgcugggggacugcuucugucugggggugcugagaacucuggggugggggcaccccaucuuugcugccaggaggagaggguaggauuugauguuaccaggccaagcuguaggcaccagggccugcgggguuugugggauacaucccugcugugggaugucagcccugggaagggacuugggaggaaggacgcugcugugguuuccaagaugggcugggggaaggggcgcgcagaagccggcccagcgcugucgcucagcagcuggggcaggaagcaggcugugcugggagucuggcagguggggaugaggcucacagagaggagaggccuucaacgccgggucauccggugugcacacaaucaacucuagccagguggggucugcccuugagacugggccccagaccaggcccagcccagcccacucugaucaucugaccaggccaggcacgugccccaggccccccucugcacacaccaaggcccccucucucccuaggggcagugcccagcccucugguggugggagaggacacaggcuuguccucugcugucccuggugccuagcaccaugcagggcacacugcagccgugugauccccauaaaugaccagugacccugaguccugcugccucuauccuccuccacuucagcaccccucggccucuugcagaggcuccucccugcuagacagggugggggcuggguccccuucagaccucuccugggguuucuuccugcuucaggcaugaaacagggccccacagcccucuagcagccuggggacucugcgucccuaggacacaauuggucaguuccagggucccuggcccacagcaggaggcccuuguugcuggacagucugggugggucaggcuuuacccccugcugcuccaggaggacaguacaagaauccccuaaaaucuggucuggcagaugagccgugcacagcccucaggcagggaucacccaggccagggcgugcugaagaagccuauggggucagggccccacaagugcggccaccauccgacucccaugggccugggcgagucuucuuccuccuccaugccacucucaaggagggccaggcccugggggcuuccuggaggaggaggcagggggacaggagaugaaaucagccaggugaggaggcacccggggggggccacgagggcacaaccccccuggcggagaaugccagcccagaaggcagcugcucccagagcugagucggaaugcuuggcucugccaccagcugggugccaggcagguccugucccagcagcugaggccuugccucaccagcaccaggcgccgaccccaccacagaugcagggcugccggucaacugcagaagagaaacugagggcuggacccaagaacaccaccuggacagccccacuccuguuccaauggcccuggccagggaagcagggccccagggugggguugggcagggggcugugcucagcagagcgugagcuucaggccccagcaccauggccugcacccaaguccccggccugaggaccccccggucaggccggucuagggucuagggccucggugaggguucggguggguggaggagcugggggcucuauaccucuucccccuuucccucacacuccugucuccccuccuccgggaccugagcugggccuggcaaacaauaaggccagagggggcugggcgugguagcaagcgccuguaaucccagcaccuuuggaggcugaggcaggaggaucgcuugagcucaggagguugaggcuacagugaguuaugauugugccacugcacuccagccucggugacagagcaagacccugucucaaaaauaaaauaagccucauaggggcugcuggugccagcagccacggggcucucaccccaaaggggcuguugauggucccccuguagcaggacugccagagcaccuucuccacacacccgaaacaacaaccugggcugugguuucucagaccuucuucugaggagcugugccuccugcccuccuaugggaguuucaacucaauuuucacacuuugguuuagcgaggauggcagccuacuucccccgcccaggccccagacugaagcucuucugugccgaguggaaggugcauuagagucaccaagggcccaacauacaccugcgggcagcgcuggaagccauguggcagcugggaccccacgugugccccucacaugacaaggccccagggaggccaggggccccuggcuuccagaauccugcaggggcagacagcuccugguucuucugugcccauuauacccgugggagcacagggagggccguggacagugcaggagaggcaggaagggugggggcugggggguggccccagagagccuggcuguccucacccugcugcccuccugagcuggcuccagaugcagccuggcgggaggagguggcgaggccgagaguugccgugguaacucuggcuuccuccagggccuuugaaaacauugcuuauuuucuuuugaaacugugguccagagaccguuuugagagcuguuccaggacagaguggggcagguggaugggggagccucauccccacagaggccuggugacaaacccugacucagccacaggagcuguggggccacuggaagguccccaggcucccgguuccucagugucccccucuauaaaacagagcugaucauggaaccgugccuggcucggaagcugcucuguagaggcccauccacccccagcccucccuggcugggcagggaccaccccuccucuagccugggcgcugaggggaugaucccaucuaaugggcauaccguccuaacagaaagguagugauggcaaagcucagccuaaaccccaaaccugcuaauggugggacuucaggccacguugcagcuucuugcugugcucugggaaggggcuucuguucagacuccagggccguauggggaggcugccccuagacaagccccggccccaggccucugccgaggguugcagggaaggcugguccuggccugcagggccugaaagagccugggccaacaccaggaaggacccgagggcccaugugacuuuuaauagggcagaacagcugggccaggagggggugggagggacagccggaaaugggggugacgccagccuguccaccucaacuguccccgaggcuaccagaaguagucgggagccacccuggguggaaaaauggggcaagaaggagugccaggcacugggcagaggccucaccugagccuuggucuucccagcccuagcauggacaaacggggccaugccaagcucuccgaccuucagcagggaccuugagcuggagcuaggugacaacaaugguggugauggucacugccgguuucuggaugaggaaacggaggcggagggaccccccuagggccaccuacgagggagggcaauggcagcaccaaauccccaagccccguggugggaaaggcacaggugccccugccccauaacaaaccccauguggcagggcuagagguuccccagagucaggaaugcgaaagacaccugcucuccgaaagaccuggggcagagccugguaaaggaccugugcccugaacguaugcagagcuuuccaaacucaacagcaagaaaacuggcaacccaaucuuugaaagaugggcaaaaaacaggaacagacccuuccccgcaagauccacacacagcaaaaaagcacaugaagagaugcuccaccuugccagggaccaggaaacccaggucaagcugcagccacaugccgagcgcacccaguggacuggcugccacgaaaaagaccaaccacaccacaugcugcugggggaggcaacugggacgcauacaacgggggcuguaaaacgguccagccaccuugaauaacaguuuggcaguuauguaaaacugcugcuuaagcagugaaacccacauucaccacaugacccagcugcuccacgcacagguauuuacccaagagaaaugaacuuagguucacacaagacuuguacacaaauguucuagcacguuucuuguaaaugccccaaacugaaacaacccauaugcccacugaccggugaacgggugaaccugggguccgucgcuggcuugcacaugugggugcaacccugcccggcaauaaaaggaacagacgaagggcacaccacagcacgggugcacagacgacgggcacgccacggcacgggugcacagacgacgggcacaccacagcacgggugcacagacgacgggcacgccacagcacgggugcacagacaggcaugccacacagacgacgggcacgccacagcacgggugcacagacaggcaugccacacagacgacgggcacgccacagcacgggugcauagacgacgggcaggccacggcacgggugcgccucuggguaaucaugcugaagcaaagaggcagaacagcaacgaugugcaagugccuucugaguccgcuuguugaagaaaugcaugcugugugcacccacagcgacggcccgugguugcccugggacggggaggaggggcaggaagcagagaucccaagggccccaggggcaccuggggaguuggugaugguuucacggggguauaaauuugucaaaacuuaccaaguuguacccuuaaacaucuguauuuacugugugucaaucacgucuaaauaaagcuguuugaaaagcccccacauccuaagucccugaugacugaacuccccggggccaguguuucuucugggccccaaagaccccaggcugccaucuuggcgcuaacuucuuccgaggcagagccaacgcuucccaggggcaagcagcggcaugggaaacaccgaagccgcguccuuagaagugcacuuuuaggauccaucaaaguuaggacuggaguaacuauggagcccgaugucaguuaaaagagagucccgcuuucacggugaugagggagggcagcccaaggcccuggcugcugagugccuuucaccaaggcgaccucaggcccaucucagcuucucucugccuugucuacaaacaaggaaauaaaagugcagaagcugacaugcacacaacuuagccugcacagcagcacucggcucuccaucacugugagguuucauaagugccggaaucuggaacuccugucaccccucuccccacagagccauccauacaggcaccucccugcucaaagcucaccugugggaagccucucugccaccugcucccaccucccaagauacuccagccuccggaggcgcccucugagaugccccgcccccaggaugccccgccucccaaguggccgggccccagagaugccccaccucccgagaugccccaccccacaagccgucccaccccacaagaugccccaccccacaagccgcccuaccccacaagaugccccaccccacaagccgcccuaccccacaagacgccccgccucccgagaugccccaccccccaagcugucccaccccacgagacgccccaccccaggaaaugccccaccccacaagccaccccaccucccgagacgccccgcuucccgagacaccccgccucccaaggcgccccgccccacaagccgccccaccccacaagaugcucugcuggggauuggggauggaggguggcucucaggauggagcccagguaaccugugggguuccuggagggcuccuugcaaggcuacuaaaagcaguguuuguacucuaugaaggauuguuucuuucuuucuccuuccugggaauuaauaaauaacagaaucgacuuuaaaaggggggcugccaagcacacuggguuccugcccagccuguccgcuguuuccaagaagcagcugaaagggagcaaaaggcagcaggcgcugcccgggcaggccuaggucagcuccccuacccaugccagcugcucgcugcccccgcaggccccggacagccaggagccagaacuucgggugggagcucuccaggccagcacacacacccccacagcugcaggaaagggcagggaucuggucgccccacccauaccuuacccccacccagacgggccaaguggucaccccaaguccugcccaggcaccccagugggggacgaggacgaugguacaucagcucacccgccuuuacguacaggcugggcaucugugugucucuaguccaggcccucccuugaugcucuuggggaggggguccaccaggcagggccacgcugcgggcucugugccugcucaccgacaccuagggacugcacauaugggaaacacaccgggaagugcccauucggcucagccacugggaggugcuggggccugagacacccuccccaggaggacagugaggcccugaggcaggaaggaaaggaggaaguaccccuggagauacugggugaaggaggggaggggcucaccaaggugcuuccaggaagggacgcugggggccggaggugaacggccccuccagccugggucccugcaggccaaccccucacucucugcccaccaagaaggggcagugccaggccuggguguggagguuggggacggggccagacuccucccugggugacguagggcccucucaggcccuccuagguggugagcagcugccccucugaccccguuguggccuccaggggcgaaaaggcagcauggagggaagaggagcaggaauucucuccuaggccaggaagcggaagcuccacucacagggccccuggccccgaggaagccgccugucucagcaucuaaaaauaggugucaggcgaggaugcuggcccucuggccccgccagcugggggaugugaggagucacuucccucgggaccaggaggacgcacacaugcucagaggaugcuggugucucccaggcaucagggguggugggcaccagugccccgaggaccaagccccuuccaggaccagcuguucccgaggcagggaagccaggaagucccuagcccuacucuaagccucuaagcccuacucuaagccccucggaaaccccuggggucccacucgggaaggagcuccaggaucaggacuguucugggcccccaucggccuggguccuucgccuguccuggggugagucucaugcccugucaucuguuuuaccuacacuguuaccuggguuugagcuuugagauuaguucugcaccgcagcggauaucaugcuccuggcagggcugugagggaccuggccuggcuggggagagaagugaggaccccaggcugcccaccugcccugauccuggagcuccauguaacagcacagggcgcccugcggggucccccaucacccagcccucucccucccauccuuuaccuucucugaaucacgccacuuccauaacugggagcccgaggggcugaggaagagggaagcaguaacuuuccaaacguggugggagagcacaugaccagagagaagggcaaggcguggugggggcgugauccaccaggcucuggccaagcugguggcucccuccucucaggccccuagcauuuggaaucucacaccuggacucucaaagcuccccugcugggccacccacauccuggagagaggcgcuuacaagcucugugccccuggucccccagcccuaccgccaacuccuugagcccgcagcccucaaagaccuugugcgggggguggggguggggggcagaugccuuauccuggccaucccacggccauggcauuggcggccagugcaggaagccuacagccccaaaagugagauccggcugccagcugaccuuccacacccuugggcguggcccccugccugaggggacuccuccagcacugggggccuaccuggaggacccucaagggucucucaugauucagcacuugcucugcagcccagguuggggggcuuaguuugggcccagaaacacaaagaaugguguguagggcugggggacacugaguaaguccagagguuccuggaaggcugcccagcauaccagguaccacuguguccuacaaggcagguggggacgacuuggaaguggagaucacugaagcccauuucugggagagccugguucuucuugcccagaggggugcugggaacaaggcggacaccugcagggcuggaauaucacccagcacccauagcacgcccagccuggaucacagggacacggggcccaagcaaggggcagggcaccuggcuccucuccagccccagccccaccccaaccucaggguccugucuaaaaccacgguggguacaagggugaugaccugcucccucgcacaggcgccuggacucuaagccuuauugacucuaugagcaaagcucuucccguggugcgauuucaggugcggaaauagggguagggaucuuuuggggucugucuccuugucugggcuuggaagcaguuaugagaaagggauugggggugaaccagauuucugaaaguugagcugaacugggcgcuggggugggugcaggagaaggacccucaaacccaggaaagaauggagggcuuucgggcaugcacccuggugaccgcagggagggcgagugacuugucagcacccggcagagccacagccagccacaggggcgaccggggaaguaggcccauaccucccugcuuuugcucugugcccugcacugcuggacagccucacuggggccagucuguagcagagacaaaccacagacuuccucuucucggcccgcuugacccaguggccguuuccccaaagcugugcagccagacagccugggggagccagggaaaguccacacacccacuuggugaaaccaggcacaggauguccuagcccccucccccacagcgccugccaggguugcagccccucucccggaaggacggcgaaagacgugccaaaugacagucaugugcugucuggaagcgagaaauacccgugagcgaggcuucuaaucagucucuuucccggccggguuuggcugcccugccacugggagguggcuaccagcugcauuagcuugggggagcagccagucccaggcgggggacaccgcucuucucccugcggggacuggugacaccucuucuggacucccuggccagcccccgaggagaagacucuuauauccauuacacagaugaggaaggcaaggcucccacaggccaguucccugucccgggacacaaacucuccugcccugcuccuggcagcaggugggucucaggugccagccgccucugauggaggcuccgagacccacccaagggacaggauuuccacgcugcuuggccagggcaucugcaauguccucccugcuugggcccgccgcgcacccagggagcccaguucucacuggcccccaaagcggucagggcgcaggugcaugcugcccagaccuucccccucgcaccuuggcuugggaagggagacagcaagagugugagugugugugaaggugggagugugugugugugcacauucgugugugugagugccugugcgugugugugugggcuccuuccugggaaagaggucaggcuaccccagcugccuucucccacaggcaaggccucuuuccucucuaaaauggaacuucuaacaagugccccacccagauauccauugucaaccuccuccccaccagccuccccagagcccacaggacugcacuguguccuucuggacccugcaggguucccgcagccccuuccccacugcacauccugccugucugggcugggcucucugaggcagaggucccuuuggaccccuggccaacacccacgcccugagcccuuccugcaccaagcccccugucaacacucaggcaugucagcaaauccaccaacaccaccaggagguaggcucacugugggcccccacugcagacggggaaggccgaggcccaggaccagagcaguguguuggggacuccaccaaggaggcccaagcccauggcacugugcucucagccacacacccugcgacaccaggguggagggggguccaccaggguggugcccaccaaccccaccucacccagccuggcauugcuggcuaccacugagccccaguggauggguggguccacagugacuguggacggacucaguucucaaugcuuugcagggagcaggcccuggggagaggagcggugaggccucagagacauuuccuugagccuuaauaacaagcacccuugggaugugucaggucuccaccccagcugccugggaaacuuccaggcccgcccuggcgacacucccagggggcugccagggagaccucucagccugggcaggcaggaggggcucacccagugcugacacaccguccagagagcaaaaauccaccuccggagaaguccccucccgugacuccccuucagccucugccccuagguccacacucucccucagccccugcccccagguccacacccucccucaacccccacccccagguccacacucucccucagccccuacccccagguccacacucucccucagcccccacccccaggccuacacccucccucagccccuacucccagguccacacucucccucagccccuacuacccccaggccuacacccucccucggccccugcccccagguccacacccucccucagcccccacccccagguccacagucucccucagcccccacccccagguccacacucgccucgucaggggacggggcuucaggggcuggcagagggacauccugugucuggugccucucccacaugccugggcugaagcaggccaccacuaagcaacggcugaggucccagggccgggccuggggaaggcgagccccucccaaauggccuagcugcccccacugccagggcagugccgaaggccacagugacucccaccagcgucccaagcaggcugugcagaacagcccggcuuggggaaggugggaugugacugccccacucaucucccagcugagaguucaguucagccuccguccuucccccuccaaauaaucauccgcacugggauccucagccguccagaugggaaacagaugucucuggucccacacacuggcuccaggggccauuuaaaaaguuugcccucccugccucaacuugagaaacacucgguccacugggacaucagccgagucuuccacgagaagggggugacagccuggggggcacggggaggggcuugcagucuaugcccaggggcguggccacggggaggccgcggccauggacacccacuccaguccuuccaggccaagaagggauuuccacccccuccccaauucuaacaccgacaggaaauggaaacaaaaggcgaaagcccaucagucacuucccagcagcaaagacugcggucaggagaaagccauucucagcaaaagacccuccuccacccacgcuggcacccaaagaugcccagcgugggggccccucuugcaaagcagcggccccacucccggacccugccauccacuccaggccccuggugccacucucuuccuugugccaacucagaaccgcgggauccccacuccugcgaggccuccagagcccuucugggaggaggccuccgcuggaacgugucugggugaggagagggagaucggcucccaggcagggacggccagggugcgcgcaccccagcuucugggccaucccggcgggagucugcgcuccuuuuaggcgcgacccccaggaaggucucggguggugaccgcagauuggagagugagcugggcuggggaaagagugaggcggaucgcccccaaccuccggcaaagugugcgcccccgccccaccauccaggggcggcggcucuugaugagcucaugggggcggggcgccaggagucccgcccgcgagccccccccucguccccgcgaagcagcaguccggaauccgcggccagggacccgcgcaggccccuccuuagcugaggggcggccggguacucgggucccgacccgcgaccaccgcacccaucaccaccacagcgggaacugcccggcggcccccagaagccccggcccggccgcagaggugggcccccgagcacagaggccccgaaacucggcucgcagcccucagccccaaugucggggggcgcgguggccccgggcgaccccccaccccgcuccuggagcccacagguggccccacaacuucgcggcccgcgcugcgcccgcggggccuagcacgcugccgcgggaccugcccaacguggagugugugccugcccccucccgccccggcccccggcgcagcccuuacccagaagacgaaauugaagacgaagagcagguacuugaugcacuuggugcagcccuccacucccauggcggcgcgggcggcgggcggccugcggggcgcgggccgguccugggcggcgggcgggccggcgcggggccuggcggguggccggcaagggggccuggcgggccgaggggcgggggcgcgaagaaaggggcgcgggggcgcgggggcgcgggggcgcguggggcgcugggcgccggaggccuggcaggaugcgcgguggggucgccgccgucgccgccguugcgcgcucgcucucuggccgggcgcgcgccucgcuccgcaguacuuauagggcgcc

SEQ ID NO: 21436 - RNA, 3191 nt, Homo sapiens
caggcgcggaagccguggugcucggccggcagagcacucgguuucccagagggcugagcgcgccgcacggaggugcggcgccgaccaagauggagacugccgagcagccuugagccgguagguuuguggugagggaggacgggccgcgcgggccggccgagccuccgggaggucaccgagcgcagcuuuaauaccugagcucgaaggccccgcugugcucgccgacccccguaccucgcggccgggcccuugggacccacagcauccuugugaggcccggaggccuguccagcccgacuggacagugccgaggggcaccgagagccagcuuggcaccgagaguucguuuguucucuggcggggaggucuugcuggcacauauaguggagaaaggccgggcucugcguucauguggagaaagagacggcuuccuucagccuacggacaugaaggagucaacucuaccuuccacucguugccggcuuucgccgagaaccccgagaaacggacuaccggagucccuaucuugcagcccgauccccgcuacccgucggagugccccgcugaccaggcugcuucuggccgcggcggcguuccgcugcagaggacgggagugcgaaucugggaagcaggguucugguugaacuccagcuucgucugcaacauacugugugacuugggcaaauuauuucccccgccccguuccugccagcuuuaaaacggucaucaguggggggugcugcguauccccuuucacugggguggcuucuucacugaggagagucgcgccucagaggaacugagguccugccuguguucgaccugguggggggcacuaagagccccugauaguaccccugaccccauccuuauugggugcacaagacacaggucacucugggcgggcaaggaguuuugguagcaggagaggagucgguggauggauggcugaggacagugcagaaggguguggcugggccgucuuuuuuugccuggaaauucaaguucugaggcacccagucacuccagcacuaaaugggugcaggaggcagcacuugucugcccagcuggaaaggcaggguaugugcugaguguuacagguggaaggccacuggaggucgcuccaggagccgcggggauuuaccucugccuaacagggcugcucaaggugauggucgacaccccacuuuccugagagcuugacccucagaugccagggccuuggcugcagauuccuugggagcucccggggaucuuccagcaaauaggagcaaaucuuuuccccguggaucaggaaggugcacgcucuuuguggaauacgacugcucaccccgcacagcaagcagcuuauaaguggcccuccugccugauuucagcccuggguucaagcccuggguggcugcuuacuaccaaaaucgcucaguagcuccaagccugccugcagaggguuggcaccauuaaaugagguaacgagucaaaagucccuacccuggguccuagccugucaggggcuccgaaaacccaggcucaggucgguccugcccggcaccuguuucacacauguacacuccggucugagguugguccucucccccaccccacccaccugcaguugagcagcugaacagaggccaugccggggcacuccgaggccugagacgaccacgccugugccgcugaggaccuucaucagggcuccguccacuuggcccgcuuggcuguccaaucacacuccagugucaaccacuggcacccagcagccaagagaggugagaggagggcuuggagggggaggcgggacuccacccugugugggacaguucugucaguugacccuccacuuguccaggggcaguggaucugcagggggaacucauucucaauacuguuccuccugagaaacaaauuuucugggcuguuuugguuuagguguggcguggcccuggggacgcauggcugaggcaggaacaggugagccgucccccagcguggagggcgaacacgggacggaguaugacacgcugccuuccgacacagucucccucagugacucggacucugaccucagcuugcccgguggugcugaaguggaagcacuguccccgauggggcugccuggggaggaggauucagguccugaugagccgcccucacccccgucaggccuccucccagccacggugcagccauuccaucugagaggcaugagcuccaccuucucccagcgcagccgugacaucuuugacugccuggagggggcggccagacgggcuccauccucuguggcccacaccagcaugagugacaacggaggcuucaagcggccccuagcgcccucaggccggucuccaguggaaggccugggcagggcccaucggagcccugccucaccaagggugccuccgguccccgacuacguggcacaccccgagcgcuggaccaaguacagccuggaagaugugaccgaggucagcgagcagagcaaucaggccaccgcccuggccuuccugggcucccagagccuggcugcccccacugacugcguguccuccuucaaccaggaucccuccagcuguggggaggggagggucaucuucaccaaaccaguccgaggggucgaagccagacacgagaggaagaggguccuggggaaggugggagagccaggcaggggcggccuugggaauccugccacagacaggggcgagggcccuguggagcuggcccaucuggccgggcccgggagcccagaggcugaggaguggggcagccaccauggaggccugcaggagguggaggcacugucagggucuguccacagugggucugugccaggucucccgccgguggaaacuguuggcuuccauggcagcaggaagcggagucgagaccacuuccggaacaagagcagcagccccgaggacccaggugcugaggucugagagggagauggcccagccugaccccacuggccacugccauccugcugccuucccaguggggcuggucagggggcagccuggccacugccuagcuggaaugggaggaagccugcagguggcaccgguggcccuggcugcaguucugggcagcauccucccaagcagagaccuugcugaagcuccugggguguggggugugggcuggaagcacuggcucccugguagggacaauaaagguuuugggucuuu

SEQ ID NO: 21437 - RNA, 2551 nt, Homo sapiens
cagcauuuuucggccucuuuauuuagaacccggcggacgaggggccggggcagugguacagacggcucaggaaccauuuuaacagacuugucuucaaguuucagauaaacacagucauaauaagagagacagcgaaagcgcgaagagacugcaagcuagaugggcauguauggcagcuacagcuugugagugacccccuuccccagaguccgcgaugaaaauaaaguuacacuugucaauaaccagaugugggagauggagagugccuuuggcauaaccaauaaccgagcuagugcguggcagagcgguccacgccuggacauaaauagaaaauauaaguuaguauaacuuuaaaaacuuuuuguacaaauauacaugguuuuuuuauuuuuuccuuuuuuuuuucuuuuuucuuuuuuuugcacugaguuucagcagagauuaaacauuuuauauaaaugacucuuaaagcuuuacaccuugggaccaguguaccuucucgugcagaauacauuuagauauaaaaagacguuauuaauacauugcacaguuuucaaaauuuaaaaacaaaaccgaacgcugcucugcggcagccgccgccgguugcugcuacaugaacggucccagccgaggcccagcgcccuuccaacguccgcugccccggcagguucccucggggcucuuugggcucuaaacugcgaggagaggggcggucagcaaagccggcggggacccggcgggucggcccuccgcgcccccccaggugcgcuguacucacuuggcucaccgcagccucuugcgcggggucugcuccaccgagcccacgccaggggcggcgcuuggagagggacacggcgcggggacaucgcccgacgacuucucaggcgcugaucucuugcgcuuggcgaagaaaucugcgggcgacagcgcgcgcggccggucagggcggggccggcccggagacccgagagggggccgggagagggcgcggggcgcgggccggccggggugggggcgccguccccgcccgcgccgagguccgcggcgggucagcuuuguuuacgucgccgcgcaaugugcuguguaagcauuuccccuugucccgcggccaagccccccggggccgccgccgcgcuuaacccccuccacgccgugcucacggcgcccggccgcgcccggggaggggcucccgcggccgggggcgaaaacugcgcucccggggggucgcggccgggauucagccucccaccccgcccgcgcgaagccgcuggagggcacaacaacggggcggggagggggguaagggcgcagccgcgcccugagcgcugcgggcccuuuaaugccacgggaggaggcgggaacccagcgaggcccccgagggcuggggggaccggccggccggacaaagcggggccgggccgggccggggcggggccgugcggggcucaccggagaucagaggcccggacagcuucuugaucgccgcgccguuggcgcuggcggccgcggugccggccgcgggacgucccgaaauccccgagugcagcuggucagcgagaggcuccuggccgcgcugccccugguucgcgcccugcucggcgcucucuugaggcgccgcguccggggccggggccggggcgggggccggggccggggccggggccggggcuggggccggggccgcgacuggagccggggccggagccggagccggagccggggccggggccggggccaggaccgcgaccgcgaccggagccgcgaccggagccgcgaccggagccggagccggggccggggcuggagccaggaccgggacugggggcgggguggacgccggggccgggaccgggacacuaggcagcugcuccggcgccuccucgaggccgucgagggacucagcggccggcucgaggggcgggcugacagccaccgcgaccgcgacgggccgcggcgccagcagcaggcggcagcgccccaccugcaccgucucgcgguagaacgcgggcaccgagucgcuguccacuucgguccacugcaggcguccagggccccgcagcggcauguccugcuggaagucguaaucccagcgguucugguccucggcguucagcucggccaggcgggccugcagcucgcggcucagcuccucgugguccaccggcccgaagaggcugcggcaggcgcuggugcgcacuaguacugggaaggucccacgggcgacaagacgcuccaucguggaugugcugcggagggacgcgucggacauggcccggggcugcgcaaacgcgggcagcgagagaggagaggacagcgagaagaaggggaaaggagaggaggagagggcggaggccgggcgcaagggagaccccgcgccgcccgacucugcgugugcgagggacgcggcggcuaccuggcuguccggugguggacucuucugcgucggguucgccugucucguccggacggcagccgcgcccccucgaugccugcuggcuagcucgcucgcucaggccuggccggcaccccucgagcacagcgcacuuggccu

SEQ ID NO: 21438 - RNA, 7812 nt, Homo sapiens
agucaggggcugaggagcgaguugcgguaguugcuguguaccauggucucggagguuucugucccgcggcccguuagguccuggucggguuuucagcgaagcaggccgcuccccugcguuucccagcgggcgugcugugccgcccaacaggcucugccuccaagugccaaaaacuccuaguaaaguuugcgccucgcccgccguccacaccccagcggcccugacgcuguccccuccgcgacccucgccucuggaaaaagugacaggcaaggccacgcccccgcgagggccggccuggagcccgcagcccccagggccugggacggugaggggcgugaaugcggcggggggcggggccguugccgggggagggggccggggcgcaugcgcgcugcgcagcggggcugaauguuucccaaguguuugaaacugguauuuggguuuuccacguuggacaagugcggcucggcggccagcggagcgcgccccuucccgcugcccgcuccgcuccucucuucuacccagcccagugggcgagugggcagcggcggccgcggcgcugggcccucucccgccggugugugcgcgcucguacgcgcggcccccggcgccagccccgccgccugagagggggccugcgccgccggccggggcgugcgcccgggagccaccgccaccgcggcccgcgcccucaggcgcugggguccccgcggacccggaggcggcggacgggcucggcagauguagccgccgggccgaagcaggagccggcgggggggcgccgggagagcgagggcuuugcauuuugcagugcuauuuuuugaggggggcgggggguggaggaagcggaaagccgcgccgagucgccggggaccuccggggugaaccauguugaguccugccaacggggagcagcuccaccuggugaacuauguggaggacuaccuggacuccaucgagucccugccuuucgacuugcagagaaaugucucgcugaugcgggagaucgacgcgaaauaccaagguacggccgggugauggaugggcgggggcggccgccuccuucccggcggguccgggcgcgccgcggagccgggccgguccugccguggaccggaggaagcggccggcuccgcagcggcggcccucggcaggggcaggaacaaaaggucuggagcgccuuugauucgccaagguccuugugugcaaagcccgggacacggaggaggaaggaggcgcgagaggucucgcugcaaggcugcgcgaccaaagcgcucuuuguagugaagugaugaggcgggugcugcgggggagggggcggcggguccaagccgcguccucuaggagggggugcagauuacggcgcgagauggagggaugugccggcgccuggggcuauagggcgccgagacggggcugcaggaggagggcggcugugggccgggguucccgcggacccggugccucggucccgggcaacgccguuccucuggcccuucuucgucgccccccacucagucccgaaucugaguguuacauaaaguaccggguaguacuccgcucgggguaggucggccgcccccgcccagcccccuccggcccucacuuggagcuggacaccgaguaggggccgacugcgaggggcgacgccgccgguuguaguuugcggaggacgagggcuuuucucugugugccguagggaagggaagggaaggggaggagcggaggcggggaaggcgcccaucugcgcugcgcucgggggggcgcgggcagaucgcuggcuuggagaggacuguggcaggugagaggaccugugcgucguucucugcagaccuggccgccccgggugucagagagagguggcgaguucguguccgccgggaauuguuggcuguuggggaaacuuuccugcgaggucagucaaggcuuugggggcucuguuuugaauguggaucaccacucggaguuuacuaauguuuacaaggcugcgcaguagggaaacggaagaguugggugggggcaaaaaaaaaaauugaccgcuauccccgaaaguacuagacgccucugccgggaaggcgccccugcgcguucuauccgagacguagcuucgcagcgaauuuuauaggaacuucauuagcauauuauggaacgucccgccucagccccccaguaguuggcugugauguccuucguggaauguccuuaucauuccccugcggaacgauuggucgcugaggcggaugaaggcgggccuagcgcaauaacugguaugggucuguguuuccgcugucuucuuuuuucuuuuucggggaggagcgggguggaggguggacgaguugauuugaacgucuucgggucgcucggccuccagccuuggauugguucuucucgcugcuggggcgggccgugcucuuccgcccugcggugugguugguucuccuccuggccuccgcccuccaaaucggcgauucccauaggcggcggcucucggggugcggggcgagucucccgcuggccuccuccccauuggcuggaggccuggcgggugucgccccugccccucuccccgcucagcccggccacuuucgggcgcggauuuauagcaguagcagugaucccgggccugugggcucggggccggggcugcaguucggaccgccucccgcgacccgcggggccggcucggagacaguuucaggccgcaucucugcugacccgaggguggggccgcgcguggccguggaaacgugagugacuggggcugcguccacgagggggacccucggcgcagaaacuuuucuggaaggugcuguccucgggccggacgggccccguggggugacccuggggcuccggacggaaggaaggcaggggcugagaccacuuugaucguucgacgauagaaaaaaguagcgcggggcggggugcaggguuccagcuguccagacagcaaaguucauggagccacuuuguccuccugucguugcuggggagagccuggcuugcugcuugcuucauguucaccuagggugaugaacuuuuuggcuucaggaaagaucacaguccugcccccccgggaguacuggagcggcgcagcugggagcgccgagaagcgagcgaaucugucgcaagggucacagcuccuuggacuucgguguaaaugcugagcucugccgcguaguucugaaagacuuccacagaccuacucuguaggaagucaaacgucuuuugcuuaguaggcaucaguuguauguuaauucauaaacuuggauuauaauuaguuugucgauuuaaaaugguguuugagguugcuugaauuauuuuucaaacauuaucauaaaaauacccacccacccccugggaaguucgcuucauaaagaacuucagugcaacccguauguaaaauuaaaauacauuuaaaauaauuggacaaaccaauuuaaauguugcuacaaccccauuuaaucuguaaauugcaugugcugcugcuuuccaugguaauguugguguggaauauguuuggaaaaaaggcaguagugucugaagcugaguugcuggcauugaaaaagcagagugucuggaaggauggcuuccuauuuagcagugguguuguuccuguuuauaaauauuuguacuuaguggcuuuguugauaaaauacuuugcuuggaguaucaaagaaauauuagguaacagaaauacuucuugguaauuuugcgaugggauaucuguuucucuugcccacaaauuaggcuucaccuggauggaagcuugcuugugauguaaaauaacuucuguguuauuaaauuuuaaauuuauaugauacaguuuucugugaaaugacaauauugucuuuagaacuuugauuacugaugaaaagaagugauaccauuuuguaacccuaaauccauuuaaaaauaaaugguacacauauuuuaacauuaugauaaauaaguugaauaaauugguauuacuuggauacguugaacacagcuauuuauuuuuauaauuaauuacuauaugagacuagggcuuuccuccugguggcaggcagccugcauuguuccucuaggagucuucaaagcugucuuuaguuugagaauauacucuggaaaauauuaccauuuagagaagcuucagcguuggccugaguucuuauguuuacucuaguguuagguauaugucuuauaacuauuuggagauaagaucuggaaaggaaggggguaacauuuuagacaaucccucccacucucagccccuccccuaguuuacaaguaguauuguuggccaggcacgguggcucacuccuguaaucccagcaccaugggagaccgaggcgggcggaucaccugaggucgagaguugggagaccagccuguccaacauggagacacccugucucuacugaaaauacagaauuagccgggcgugguauuacaugccuguaaucccagcuacucgggaggcugaggcaggagaaucgcuugaaccugggaggcagguugcagugagcugagaucgcgccauugcacuccagccugggcaacaagagugaaacuccguuucaacaacaacaaaaaaagguaguauuguugccuuguuuaaagagacugcaaaaagguuuuaggagaauaaucugguacuguuuaauuuaaugguuacuguuugaggaaaaagaacucuggaauuucuguguauuuaaguagccuuuuuagcaaggcuguuuacuucaacuagauuuuuuaauagcuuuuguuucuugagaaauugccuaauuacacuugccaaauuacacuuuaaaaucauauacacuguccucuaacaugcccaggaagguuuacauuuaaauacugaagagguuuucuuuuguuuuugauaacauuuuaaaguccauugacuuuaacagaugugaagauguuuuuguuuaagcaguagaugcaaaaguaaaaccuaccagcuucgcuuuaaagcaaggcuagugcauucacugcaguuaaaaaauaauaauaauagcccaucacaguggugcuucuguagucccagcuacucaggaggcugaggugggagggucccuugaaccugggaggucgaggcugcagugagccgagauugcaccacugcacuccagccugggcgacagagacggaccuugucuccaaaauaauaacaagucguaauaauaauaaagcaaagcuagguuuucuggauuauuguggcagaacuguucuugcugucacuaauacagagggauaacaugcuagaauaaauguggggacugaaacugaggaccuaagucacaaaguauccuggaccuuuacuguuaacccgguucuuuaaaucauagagagcuauuauauaaauuuauacacauucucucauuuaacaggguauucuagauguugguauauuaaaauaaagaaaauaaagaccuuuuuuauuugaaauauucaaauaauuuauaauauauuuuauuaauguuuguauauuguguauaaauguaauaaauaccauguuuauauaauguuauauguauauuaauaauuguauucaaauagaaacauuugaguaaaaaugauggcaguauagacauagucauuaauagaaaguauuaauaaauguugggucccgagcacugcaccucauuuaaacguuuccucuuaauggcuucgggcguugucacccgugcgugccugggaacuguucucagguucccugggguggcuggagcggcuccugccgcuguggaagcugggccggcauuuguguuguguuguguuguguuguguuguguugugguuagcacaggaacagauaggcccgggagagccuguggcuggugggcuuuguucugggcaagccgugcgcuggccccuaggcucccugccagcccucuccguagacccguccggggccguguggguugucccgguguccugcucgcgagugacgccuguccuucuugcccccagagauccugaaggagcuagacgagugcuacgagcgcuucagucgcgagacagacggggcgcagaagcggcggaugcugcacugugugcagcgcgcgcugauccgcagccaggagcugggcgacgagaagauccagaucgugagccagaugguggagcugguggagaaccgcacgcggcagguggacagccacguggagcuguucgaggcgcagcaggagcugggcgacacagcgggcaacagcggcaaggcuggcgcggacaggcccaaaggcgaggcggcagcgcaggcugacaagcccaacagcaagcgcucacggcggcagcgcaacaacgagaaccgugagaacgcguccagcaaccacgaccacgacgacggcgccucgggcacacccaaggagaagaaggccaagaccuccaagaagaagaagcgcuccaaggccaaggcggagcgagaggcguccccugccgaccuccccaucgaccccaacgaacccacguacugucugugcaaccaggucuccuauggggagaugaucggcugcgacaacgacgagugccccaucgagugguuccacuucucgugcguggggcucaaucauaaacccaagggcaagugguacugucccaagugccggggggagaacgagaagaccauggacaaagcccuggagaaauccaaaaaagagagggcuuacaacagguaguuuguggacaggcgccuggugugaggaggacaaaauaaaccguguauuuauuacauugcugccuuuguugaggugcaaggaguguaaaauguauauuuuuaaagaauguuaguaaaggaaccauuccuuucauagggauggcagugauucuguuugccuuuuguuuucauugguacacguguaacaagaaaguggucuguggaucagcauuuuagaaacuacaaauauagguuugauucaacacuuaagucucagacugauuucuugcgggaggagggggacuaaacucaaccuaacacauuaaauguggaaggaaaauauuucauuuagcuuuuuuauuuuaauacaaguaauauuauuacuuuaugaacaauuuuuuuuaauuggccaugucgccaaaaauacagccuauaguaaauguguuucuugcugccaugauguauauccauauaacaauucaguaacaaagguuuaaaguuugaagauuauuuuuuaaaaagguaaaugguuaaauuuuacaugacagauauuuuaucuauuggccuguuccccaaauggccauuuuaaaaugcuuggguacacuucucuuaaguggucuagucaaggaaccucaagucaugcuuuugcuaucaccaaucauaguguacccaucuuuaauuuauaucagguguauaaauguacauuuccaaaugaacuugcacuuguuauauuauaauuggaagugcagucagcagaugcuguugugaagcuaaugucacaauuaugugcaaaggugugcuuccugcuguaugugagcuguaaaaauguuacgugaagaaauaaaugaaacuuggccaguuuguuccucuaguaguauauuuaauuuugacauaaguaacuuuuaaaauuugucuuaaaaauuuauacaccagcaauuuagacaaagccuuaagcaaauuuuguauuauuguucucacuuauuauuaauaaugaaguagaaguuacuuaauugccagcaaauaaauacgugucaaaaaagaaucuguauucagacccugggucaggaaauuacugcccacuugucaaguucagcccaccaucuguuugaagauuauaugaaguuuaaauucuaguguccauaaauaaaguuucagcggaacac

SEQ ID NO: 21439 - RNA, 7812 nt, Homo sapiens
guguuccgcugaaacuuuauuuauggacacuagaauuuaaacuucauauaaucuucaaacagauggugggcugaacuugacaagugggcaguaauuuccugacccagggucugaauacagauucuuuuuugacacguauuuauuugcuggcaauuaaguaacuucuacuucauuauuaauaauaagugagaacaauaauacaaaauuugcuuaaggcuuugucuaaauugcugguguauaaauuuuuaagacaaauuuuaaaaguuacuuaugucaaaauuaaauauacuacuagaggaacaaacuggccaaguuucauuuauuucuucacguaacauuuuuacagcucacauacagcaggaagcacaccuuugcacauaauugugacauuagcuucacaacagcaucugcugacugcacuuccaauuauaauauaacaagugcaaguucauuuggaaauguacauuuauacaccugauauaaauuaaagauggguacacuaugauuggugauagcaaaagcaugacuugagguuccuugacuagaccacuuaagagaaguguacccaagcauuuuaaaauggccauuuggggaacaggccaauagauaaaauaucugucauguaaaauuuaaccauuuaccuuuuuaaaaaauaaucuucaaacuuuaaaccuuuguuacugaauuguuauauggauauacaucauggcagcaagaaacacauuuacuauaggcuguauuuuuggcgacauggccaauuaaaaaaaauuguucauaaaguaauaauauuacuuguauuaaaauaaaaaagcuaaaugaaauauuuuccuuccacauuuaauguguuagguugaguuuagucccccuccucccgcaagaaaucagucugagacuuaaguguugaaucaaaccuauauuuguaguuucuaaaaugcugauccacagaccacuuucuuguuacacguguaccaaugaaaacaaaaggcaaacagaaucacugccaucccuaugaaaggaaugguuccuuuacuaacauucuuuaaaaauauacauuuuacacuccuugcaccucaacaaaggcagcaauguaauaaauacacgguuuauuuuguccuccucacaccaggcgccuguccacaaacuaccuguuguaagcccucucuuuuuuggauuucuccagggcuuuguccauggucuucucguucuccccccggcacuugggacaguaccacuugcccuuggguuuaugauugagccccacgcacgagaaguggaaccacucgauggggcacucgucguugucgcagccgaucaucuccccauaggagaccugguugcacagacaguacguggguucguuggggucgauggggaggucggcaggggacgccucucgcuccgccuuggccuuggagcgcuucuucuucuuggaggucuuggccuucuucuccuugggugugcccgaggcgccgucgucguggucgugguugcuggacgcguucucacgguucucguuguugcgcugccgccgugagcgcuugcuguugggcuugucagccugcgcugccgccucgccuuugggccuguccgcgccagccuugccgcuguugcccgcugugucgcccagcuccugcugcgccucgaacagcuccacguggcuguccaccugccgcgugcgguucuccaccagcuccaccaucuggcucacgaucuggaucuucucgucgcccagcuccuggcugcggaucagcgcgcgcugcacacagugcagcauccgccgcuucugcgccccgucugucucgcgacugaagcgcucguagcacucgucuagcuccuucaggaucucugggggcaagaaggacaggcgucacucgcgagcaggacaccgggacaacccacacggccccggacgggucuacggagagggcuggcagggagccuaggggccagcgcacggcuugcccagaacaaagcccaccagccacaggcucucccgggccuaucuguuccugugcuaaccacaacacaacacaacacaacacaacacaacacaaaugccggcccagcuuccacagcggcaggagccgcuccagccaccccagggaaccugagaacaguucccaggcacgcacgggugacaacgcccgaagccauuaagaggaaacguuuaaaugaggugcagugcucgggacccaacauuuauuaauacuuucuauuaaugacuaugucuauacugccaucauuuuuacucaaauguuucuauuugaauacaauuauuaauauacauauaacauuauauaaacaugguauuuauuacauuuauacacaauauacaaacauuaauaaaauauauuauaaauuauuugaauauuucaaauaaaaaaggucuuuauuuucuuuauuuuaauauaccaacaucuagaauacccuguuaaaugagagaauguguauaaauuuauauaauagcucucuaugauuuaaagaaccggguuaacaguaaagguccaggauacuuugugacuuagguccucaguuucaguccccacauuuauucuagcauguuaucccucuguauuagugacagcaagaacaguucugccacaauaauccagaaaaccuagcuuugcuuuauuauuauuacgacuuguuauuauuuuggagacaagguccgucucugucgcccaggcuggagugcaguggugcaaucucggcucacugcagccucgaccucccagguucaagggacccucccaccucagccuccugaguagcugggacuacagaagcaccacugugaugggcuauuauuauuauuuuuuaacugcagugaaugcacuagccuugcuuuaaagcgaagcugguagguuuuacuuuugcaucuacugcuuaaacaaaaacaucuucacaucuguuaaagucaauggacuuuaaaauguuaucaaaaacaaaagaaaaccucuucaguauuuaaauguaaaccuuccugggcauguuagaggacaguguauaugauuuuaaaguguaauuuggcaaguguaauuaggcaauuucucaagaaacaaaagcuauuaaaaaaucuaguugaaguaaacagccuugcuaaaaaggcuacuuaaauacacagaaauuccagaguucuuuuuccucaaacaguaaccauuaaauuaaacaguaccagauuauucuccuaaaaccuuuuugcagucucuuuaaacaaggcaacaauacuaccuuuuuuuguuguuguugaaacggaguuucacucuuguugcccaggcuggagugcaauggcgcgaucucagcucacugcaaccugccucccagguucaagcgauucuccugccucagccucccgaguagcugggauuacaggcauguaauaccacgcccggcuaauucuguauuuucaguagagacagggugucuccauguuggacaggcuggucucccaacucucgaccucaggugauccgcccgccucggucucccauggugcugggauuacaggagugagccaccgugccuggccaacaauacuacuuguaaacuaggggaggggcugagagugggagggauugucuaaaauguuacccccuuccuuuccagaucuuaucuccaaauaguuauaagacauauaccuaacacuagaguaaacauaagaacucaggccaacgcugaagcuucucuaaaugguaauauuuuccagaguauauucucaaacuaaagacagcuuugaagacuccuagaggaacaaugcaggcugccugccaccaggaggaaagcccuagucucauauaguaauuaauuauaaaaauaaauagcuguguucaacguauccaaguaauaccaauuuauucaacuuauuuaucauaauguuaaaauauguguaccauuuauuuuuaaauggauuuaggguuacaaaaugguaucacuucuuuucaucaguaaucaaaguucuaaagacaauauugucauuucacagaaaacuguaucauauaaauuuaaaauuuaauaacacagaaguuauuuuacaucacaagcaagcuuccauccaggugaagccuaauuugugggcaagagaaacagauaucccaucgcaaaauuaccaagaaguauuucuguuaccuaauauuucuuugauacuccaagcaaaguauuuuaucaacaaagccacuaaguacaaauauuuauaaacaggaacaacaccacugcuaaauaggaagccauccuuccagacacucugcuuuuucaaugccagcaacucagcuucagacacuacugccuuuuuuccaaacauauuccacaccaacauuaccauggaaagcagcagcacaugcaauuuacagauuaaaugggguuguagcaacauuuaaauugguuuguccaauuauuuuaaauguauuuuaauuuuacauacggguugcacugaaguucuuuaugaagcgaacuucccaggggguggguggguauuuuuaugauaauguuugaaaaauaauucaagcaaccucaaacaccauuuuaaaucgacaaacuaauuauaauccaaguuuaugaauuaacauacaacugaugccuacuaagcaaaagacguuugacuuccuacagaguaggucuguggaagucuuucagaacuacgcggcagagcucagcauuuacaccgaaguccaaggagcugugacccuugcgacagauucgcucgcuucucggcgcucccagcugcgccgcuccaguacucccgggggggcaggacugugaucuuuccugaagccaaaaaguucaucacccuaggugaacaugaagcaagcagcaagccaggcucuccccagcaacgacaggaggacaaaguggcuccaugaacuuugcugucuggacagcuggaacccugcaccccgccccgcgcuacuuuuuucuaucgucgaacgaucaaaguggucucagccccugccuuccuuccguccggagccccagggucaccccacggggcccguccggcccgaggacagcaccuuccagaaaaguuucugcgccgagggucccccucguggacgcagccccagucacucacguuuccacggccacgcgcggccccacccucgggucagcagagaugcggccugaaacugucuccgagccggccccgcgggucgcgggaggcgguccgaacugcagccccggccccgagcccacaggcccgggaucacugcuacugcuauaaauccgcgcccgaaaguggccgggcugagcggggagaggggcaggggcgacacccgccaggccuccagccaauggggaggaggccagcgggagacucgccccgcaccccgagagccgccgccuaugggaaucgccgauuuggagggcggaggccaggaggagaaccaaccacaccgcagggcggaagagcacggcccgccccagcagcgagaagaaccaauccaaggcuggaggccgagcgacccgaagacguucaaaucaacucguccacccuccaccccgcuccuccccgaaaaagaaaaaagaagacagcggaaacacagacccauaccaguuauugcgcuaggcccgccuucauccgccucagcgaccaaucguuccgcaggggaaugauaaggacauuccacgaaggacaucacagccaacuacuggggggcugaggcgggacguuccauaauaugcuaaugaaguuccuauaaaauucgcugcgaagcuacgucucggauagaacgcgcaggggcgccuucccggcagaggcgucuaguacuuucggggauagcggucaauuuuuuuuuuugcccccacccaacucuuccguuucccuacugcgcagccuuguaaacauuaguaaacuccgaguggugauccacauucaaaacagagcccccaaagccuugacugaccucgcaggaaaguuuccccaacagccaacaauucccggcggacacgaacucgccaccucucucugacacccggggcggccaggucugcagagaacgacgcacagguccucucaccugccacaguccucuccaagccagcgaucugcccgcgcccccccgagcgcagcgcagaugggcgccuuccccgccuccgcuccuccccuucccuucccuucccuacggcacacagagaaaagcccucguccuccgcaaacuacaaccggcggcgucgccccucgcagucggccccuacucgguguccagcuccaagugagggccggagggggcugggcgggggcggccgaccuaccccgagcggaguacuacccgguacuuuauguaacacucagauucgggacugaguggggggcgacgaagaagggccagaggaacggcguugcccgggaccgaggcaccggguccgcgggaaccccggcccacagccgcccuccuccugcagccccgucucggcgcccuauagccccaggcgccggcacaucccuccaucucgcgccguaaucugcacccccuccuagaggacgcggcuuggacccgccgcccccucccccgcagcacccgccucaucacuucacuacaaagagcgcuuuggucgcgcagccuugcagcgagaccucucgcgccuccuuccuccuccgugucccgggcuuugcacacaaggaccuuggcgaaucaaaggcgcuccagaccuuuuguuccugccccugccgagggccgccgcugcggagccggccgcuuccuccgguccacggcaggaccggcccggcuccgcggcgcgcccggacccgccgggaaggaggcggccgcccccgcccauccaucacccggccguaccuugguauuucgcgucgaucucccgcaucagcgagacauuucucugcaagucgaaaggcagggacucgauggaguccagguaguccuccacauaguucaccagguggagcugcuccccguuggcaggacucaacaugguucaccccggagguccccggcgacucggcgcggcuuuccgcuuccuccaccccccgccccccucaaaaaauagcacugcaaaaugcaaagcccucgcucucccggcgcccccccgccggcuccugcuucggcccggcggcuacaucugccgagcccguccgccgccuccggguccgcggggaccccagcgccugagggcgcgggccgcgguggcgguggcucccgggcgcacgccccggccggcggcgcaggcccccucucaggcggcggggcuggcgccgggggccgcgcguacgagcgcgcacacaccggcgggagagggcccagcgccgcggccgccgcugcccacucgcccacugggcuggguagaagagaggagcggagcgggcagcgggaaggggcgcgcuccgcuggccgccgagccgcacuuguccaacguggaaaacccaaauaccaguuucaaacacuugggaaacauucagccccgcugcgcagcgcgcaugcgccccggcccccucccccggcaacggccccgccccccgccgcauucacgccccucaccgucccaggcccugggggcugcgggcuccaggccggcccucgcgggggcguggccuugccugucacuuuuuccagaggcgagggucgcggaggggacagcgucagggccgcugggguguggacggcgggcgaggcgcaaacuuuacuaggaguuuuuggcacuuggaggcagagccuguugggcggcacagcacgcccgcugggaaacgcaggggagcggccugcuucgcugaaaacccgaccaggaccuaacgggccgcgggacagaaaccuccgagaccaugguacacagcaacuaccgcaacucgcuccucagccccugacu

SEQ ID NO: 21440 - RNA, 1973 nt, Homo sapiens
uuucgauuagggccaguaggagggcggagcggccgggacgccaggagggaacuagccuaaguggggacgguccccgugcaggagacaaagagcgucccuggagcgaucagggcucaggagcccgacccggagcccggggcguccgcgcugacuucggguccccggagccuggggcacggcagggagaagacgacggcggagaaggcgacagcggagaaggaaggcaggcugcaggggcgccgucggcgcggcgggccgggaugcggacgccgguggugaugacgcugggcaugguguuggcgcccugcgggcuccugcucaaccugaccggcacccuggcgcccggcuggcggcuggugaagggcuuccugaaccagccaguggacguggaguuguaccagggccugugggacaugugucgcgagcagagcagccgcgagcgcgagugcggccagacggaccaguggggcuacuucgaggcccagcccgugcugguggcgcgggcacucauggucaccucgcuggccgccacgguccuggggcuucugcuggcgucgcugggcgugcgcugcuggcaggacgagcccaacuucgugcuggcagggcucucgggcgucgugcucuucgucgcuggccuccucggccucaucccgguguccugguacaaccacuucuugggggaccgcgacgugcugcccgccccggccagcccggucacggugcaggucagcuacagccugguccugggcuaccugggcagcugccuccugcugcugggcggcuucucgcuggcgcucagcuucgcgcccuggugcgacgagcguugucgccgccgccgcaagggacccuccgccgggccucgccgcagcagcgucagcaccauccaaguggaguggcccgagcccgaccuggcgcccgccaucaaguacuacagcgacggccagcaccgaccgccgccugcccagcaccgcaagcccaagcccaagcccaaggucggcuuccccaugccgcggccgcggcccaaggccuacaccaacucgguggacguccucgacggggaggggugggagucccaggacgcucccucgugcagcacccaccccugcgacagcucgcugcccugcgacuccgaccucuagacgcuuguagagccuggggggcgccggguggcaaaggacucacccccgcacaggcccgccuggcuucgaguuggaacccggacacuugccccucacugguguggauggaaaucugccuuucgugggaccaaacaggacuccuuggacgauuaguucagguuggguuugguuuucuucuuaaagaguuuaguuuuccucuccagagggaucaggguccucuuagggagugacgggcuuuucauauauuuuugcugaagaauauauggaaaggguggcauuugcgucacguggaccagggacagugcugaaaucagcagugcucagaaacaauuuaacauguugaaacgacaauauucuaaaauacugaugaaucuugcaucaauauaauuauuggguuuuuuuucuuuuuccugcuguauaacuccuugccaugcaaacucucaagaggccaauauauuccuggccauguuugaaugagccucuuaaaauaaacuuagagccaugcaaaugccagcagcuuaauggauuucauggaaugaaauaccgugauuaacucauagcuacauaucauugcauaaaugggauuuaucuuuuuucucacuuauuuuugcggugaaagucgagggcaugcaagaguuucucuuccagaagccaagaggagaacaaagguccuaaugcuguacuauuccacccuuuggacgccucauccaggacgcagaggacucuagguuuaacauuuuguacaaaauggaaccuguuaaucauauuaaagcacauauguauauaucuuuuauuuauaaauaaaauuuuaaaacaauaguuucaguauagcca

SEQ ID NO: 21441 - RNA, 49895 nt, Homo sapiens
ucaguauagcaaauaauaaauuuauuaggugccuacaaguacaaaauacugaaagccgcugcaggggauuauaaagauguguaagagacaagcccugcccucaaagagcuuacaaucuaggcaauuagucacacaaauaaguugugauggcgcucuaagugaccucagcagaguucuugaaaauguucauauccuucaaauucuucucuugucaaauuaaacagugggaaagagaacuuuuguggcauucacuggugacccugacucugcuugcaagcaucuuucugcuguugcacguugucgucauccucucagcgucguuuccuaacuggaccuuuguuggagagaaucuccgugcuuccugaaccuucaccaggguuuccuguuugggaguggguggcucaguugcaguuuggccuuggaaugauuugcaguccgauuuuuccuucagcaaaucgcucuuuugauuguaguugaugcuaaaaugcuaugcuuugcaaucugugguuuuaagggugggagugagaugcaauauuaaggaaggcagcccagacuuuucccuuacuuuaaacauuuaauaauagugcacuuauugauuauaaucuguacagauauagagcaaguuauaaaccucuuccuuuuauuuauuuucuucacuuagacuguauucacguaaaguguauuuacaauaagaagaaaaaagccuugagguacaaaacccaaaagaauaucugagguauaaauacaaguauaucuuaaauaauaaucuuuaucaugcuuuaucuauguuugaaagcacaguggacauguuucuuaauagaaugguauauacaacauacaaucuuacaaaucuggaagccaucaaaauugaauauccauguauaucuucaugaggaacacugauauccaaaauacucaaauuuuaaaacucuaaucugaugcccugccccaaaauucuucaaagaaccuuugaaauaacacugaaaaugguaacuaaauuauaacaaaauaaaaauccuucuuacagcucucauucauacauuauucacuuuugauccauacacaauaaauuuacuaauacugucucuugagucaauccuuaccauuacaguaaaaccugaauaaagaccacccuucuaaagguucuaaaaaacuucacugguuuggguugguuuucuucuuguugcguuuuacuaugauuacuauuuuucauuaccacuuaaauauauuuccagggcauucuaaaggaaaaaaaaaaaaaaagaaauguaggaaaaauaaaauaagacaaaaagucauaaaaccagaaaaccuauuugcugauaagaacaagcccaaugaauaaacacauguggcuuucaggaaugccguuaacaaccaaaggcggggaaaaagccuuuuguaggugaguuaaauuuacagggauuuccuugggacacacauaguuuccuauauucccaaacauagugucuuaaggcguuucuguuacaaacacaaaaaugcaaagaauucuaacagggaaaaaguguugaugcuugauuuaagaguaaguguuaucguguucaguuuuuauaucucgacuuaaacaaaaaacaaaacaaaacaaaacaaaacccuguggaucagagccaguaaggcuagagggagcaguucaucccugaacuaauccauacugguuaaaacuacaucacuauuugcaaucgggucuaaaaauaaacugcauuuggaauggguguaagagccaaccuauuacaaucaaaguacagaagagguucguggaaaaggaauaugcuuaauaacuucgaaaaaaaauacccauaaauggacaaggguguugggcccccuuucuggguggauucagggguagucagauauuccagguuaaacugaaccugaugcaucaaucuccuucuuggaggugucucagugugccagacacugaauccaccuuagacaucuauugccauucagccagcaacaaacacacauucacacuccucugugcaaaccuuucuuugcucaucuuggugagaaaacacauccaagaguaccaacuauuccaguggauacaccagucccucaacacacugcaaauaaagcgacacagguacgcauacacugauaucacaagagaaugaaguaucuucauuaucuuccauaauguauuuaaagaguuuugcuucucagaagcaauuugaauaagaauacacauaaauuuuuuuuuuuuuuuugcacagucuuacauauuccagucaaggucuaugaauacagacccucaacaaacaggaagcagcuuuaaaaauguaucaaauugcuauagucaauuccuacacuccagcuuguaguuuucuuuguuucaggauuagacacagaacccauucuucaaggacuggcaaaaguucuagaaacaaacaccauggugguggaagcgguugcguugcuucagugaucaccuagauuuggugucuuugguuucaguguucugguuacugaaggaaucccggaucuuuacaacuucagcugcacacaaauguccaaaagauuuuguguaccauucuggcauguggccccuaucagagaaaagaaagaaaagcugaugaauuauuuaaguuagaaagcauggaaauaaaaugagaaacaucuguuugcuaguucaaaugcauaaaaucuaucauuucccaugccuuugaauucauggccgagcuaccauauuugcuuugcuuuagaaccacauuuucuaagggaaccaaauuacgaaguggucgcugaaagaccaacaaacaugaaaugcuacuuucuaaacaccauucuucaugaagucaccaagaaaaaaugacguguuuguuuaaggcauucuuugcauuagacaaaaagucagaauuuccuucaugacccucaccauauaaaaaaaucagaaucagaacauaccuuaagucaacucugcacauguaggugaguuuggauuuuccuggcccacaggguucaaucaaauaccuggacaagagcacauuaacccucacacccaccacaggugcgcgaucgugauccacagagguuaguaaaagggcacaggcuccuuuggguaaauuaguccuccagguucuguagagacaaaaccagaggcagaaaugauggaauuucauagaagccaaguuuaaaaucgugcuucacucuucacuauuugcaguguggugacgggucaggcucaguggccaugcugugugacccaggccuagguaaauggcauccucuaaacuacuugcuaugguguacauguguuccccaaaaagcaugugauggaaagugaaugcccaauacaacaguguugggagguggggccuaaugggagcuggauuaaugccaauuauaaaagagcuuaaggcuggguuccauggcucacgccuguaaucccagcacuuugggaagcuggggagggaggacugcuugagcucaggaguucaagaccagccuggacaacauagugauaccucaucucuacuaaaaauaaaaaauauuagccgggcaugguggugugcuccuguagucucagcuacuccgggggcugagaugguaggauugcuuaagcuguaaucaugccacuguacucaaacuugggcaacaaagugauacccccccaucucaaaauaaauaaauauaaaaauaaaaauggcuugaggcugcacauuugcucuuuugcucucccuugcccucucuuugcccuuccacuaugggaugacacagcaaaaagacccucauuaggcaugguggguggcccaugccuguaaucccggcgcuuugggagguugagguaggaggaucgcuugagcccaggaguuuugagaccagccuggacaauauggugacaccaugucucuaccagaaacaaaaaaauuagccaggugugauggcacaugccugcagucccaacuacuugggaggcugaggggggaggauugcuugagccugggaggugaaggcuucagcagccaugagugugccacugcacccuagccuuggugacagaaugaaaccauguccccaaaucaaucaaacaaccaaccaacuaaccagaugcaacuacuugaucuugaacuucccagccuuuagaaccaugagccaaauaaauaucuguucauuauaauugccuggucugugagauucuguuagagcagcauuacaugcacgaagacacuguacaaggacugcugaaugaggaacucuguacagagccguuguuacagaggguuuaugugcucagacagucuccucuuugaaaaaagagcccauuugaaguguagcuuaaaaccauuuuucuauuucacaaaugucuuggaacacagacaccuaaaggagcgcuggcuguuugaaaaggucuggacuuccaaugugacauuuccacaaagauuuuuggaauucuucuuucaguaauaucuccagagaauuuaugaauuacacauacaucagccuuaaccacaucucccuugggacucaaauguuauuuccuggcuuauucauucacuagcuguuucugacaagaaaaucuauccuaaaaggggcaaaaaucugcuacgaaugagcauauucauuggaaggggccucucuuucugagcucaguuaccaaagaguucagaccauucucagcgaggaacacacugcuagaauaaauguagaucuguuuuccauauuugaagguguucacuacuuuucuggaagcauauguuuuguuuuguuuauucagaaauaaggucuugcucuguugcccaggcugcgguacaguggcaugcucacagcucacugcggccucaaacuccuggcucaagggauccuccugccucggccucccgaguagcuaggacuacaggcaugcaccacaacaucuagcugauuuuuaaaauuuuuuuguagagauagggucuugcuauauuacccaggcuggucuugaacugcuggccucaagugauccucccaccuuggccucccagagugcugggauuacaggugugagccaccauaugcccggccucuacuuuaaauaauuauaccaucuuguaagaucagugacauauaggcuugguucauauauggagucauccuugucacaaaaaaacaacugggaagcgcucaccuuaaaacaacguagucucgagcaggaugaggugccauacuguuuuggacauacugguaaauuucaguuuggcuguccagaauuucgaucacuuuugaauccaacaggucuacaucccagaggugcuguucuuuaaguaggcgcuuuaagauuuccucuggcacagcagggacuucaaugacugaccuccaaagccucagaggggguccuucgcucaccuggaaagaggauguauuuuucagugccaaggcaauccauacacaccuaguuuuugaagucgaauuguuaguuagacuaacaauuuuaguuacauauaaucaacguuaauugauuaaaugauauaaauaauacuauauaaucaguauauaaagaaauauugggggcuaauaaaucuaugacuuaaauaggcugcuguccccaagcauauuuaagagcaagccagaaagugaaaaaaagcuguugucaacucgagucaaaaugaugacauuugagccgggugcaguggcucauuccuguaaucccagcacuuugggaagccgaggcggguggaucaucugaggucaggaguucaagaccagccuggccaacauggugaaacccugucucuacuaaaaauauggaaauuagccaggcgugguggcaggcaccuguaaguccagcuacucaggaggcugaggaaggagaaucacuugaaccuaggaggcacuuugcagugagcugagaucacaccacugcacuccagccugggugaugagaaugaaacuccaucucaaaagaaaaaagaaaaaaaugaugacauuuguuuuuuuuuuucugggaccuauaucagagugcaugcaauaaagaaauaucagucacuggcagggcaugguggcucacgccuauaaucccagcacuuugggaggccaaggugggcagucacaaggucaggaguucgagaccagccuggccaauauggugaaaccccgucucuacuaaaaauacaaaaauuagcauggcgugguggugggcaccuguagcgccagcuacucgggaggcugaggcaagagaauagcuugaaaccgggaggcagagguugcagugagccgagaucaugccacugcacuccagccugggugacagagcaagacuccaucucaaaaaauauaaauaaauaaaaacaaaaacaucagacauuugcacucauuuccaaagccggcaaggccacccagccuacucccacuguuuguuuauuuucaagaugguagaggcggcaucaacauauaccuccgauggaccuauccugcugagccuuacaagaugccucugcccucaagagguuuaccaguccuaacuggaguuaauuucccccuaagggauccccgcucauuaaagggccaagagaacaguaacuaagaacagagaagagugcaaagggauucugaccaaauuauggaaaaaucgaagcgugucauaggauguuccgcaucucaaugccauuagcaaaacauucuagggaagucuagugugauucuguagagccaaaggaguucauuagaaauaguugaaauccucucccaaguguuacacaggaagaaaauuacucuugcuuugcccgguuuccacucucaccacggggaucuuacucaccccggugcccagcucuacaagggagguugugggcuacagauccccagacagauuaguuggcaaaagcguguuaucucugauggacccaagcuucgacuccuggacucaacuagccgacaacagggugaagccuuaccuucuuauaggacagcucagccugcuccgaaguggaguagcugacccagccuuuaaacuucucuuugacuucuuuaaacaggccauccacacaguccuggaggaaguguugguagucagcugagucaucauuacccaggugcccgagugcuuccagagugaggggcuucagcucuuguucgguauaggaauuacgacaucggcucauuuccucgggaaccugugcggaacaugacagacagaaaggaggugaguccaccuguacucaaucucaaugcccaucaguggaaaagacuggguaggaacaauggccugguccuuaaagcagugcaggcaucuucccgccggaggugggcuaucaugcugaccgcacguguuaucacgaggauaugaacagaucaccuccauaaauguaucugaaaucuuauuuccauguaaggucuuuggaaaguuagaguagggggagugaauuacauuggucaaagcagguuucucagauacggaaguggauacagcaguuuaauuccagauaauuuguugcuuuuucuuucuuucuuucuuuuuuuuuuuuuugagagagaguuucauucuguuaccuaguggagugcaguggcaaaauauugguucauugcaaccuccacaucccugggcucaggugauccucccaccucagccucccaaguaguugagacuacaggugugcaccaccacacccggcuaauuuuuaaauuuuuuuuuguagagaugaggucucaccauguugcccggguuggucuugaacuccggagcucaagugauccacccaccucagccucccaaaguguuagaauuacaggcgugagccacugcgcccggcugcuuuuccaaguaaagggacaauuucauuaaacaugauuaacucuagcugauacauuauaauauauguaaauaagacauucucaggcuauuuauaccgucuccagcuguggaaaaggucuucagguaagacaugaacaagggucaagccuaagauuuuguaccuauucacauuauccuuaauaaaggagccaaacuucucaauuccuuaccuggaaaagcuucuugcacucggcgaucauaugggccagcccuugaguggcagcuagguuuucauucaaaucuuucugaucugguuugcccaaacuuuguuuucuuugcauuacccuagguagaagaaauacaggaggggaacaguucaaauauuuauauauuuuucuucaagguauuauucaaggaaacccaaagaagagagaaaaaaaaauuuucacuggaaucuguuuauuguuaaguggauuaagaguguuuuuacuuuggucaccagaguaucucagaguuuugucaacaacacacaaaaaaacauuaaagagauaugcuuuugaugaaauccaggugauucaaaccauuuaauuaaauagguuccuacugggaacagggcagcuuguaggggcuguguuugcauggugggggagcaacuucugaggagugugggaaaggagucccagggaguuggaguaaagggugucaucaucuuuaucugccugaauacacaggcccccucccacaggugagggcuaaguccauuguuuccuugaccuuuugucuucaucuuauuugaucucucuccucuacucaucucuagcucuguaucccauugcaguuggaaugccccagucaacuuuaagaacuauuuaaauguggccgggcgcaguggcucacgccuguaaucccagcacuuugggaggcuaagccggguggaucauaaggucaggagcucgagaccagccuggccaacauggugaaaccccgucucuacuaaaaauauaaaaauuagcugggcgugguggcaggcaccuauagucccagcuacucgggaggcugaggcaggagaauggcuugaaccuggaaggcagagguugcagugagcugagaucgugccauugcccuccagccugggcaacagagcaagacucugucucaaaaggaacuauuuaaacauacauuuaaacauuauaugacuuucagaagcaaccuaaccugcacuagcauaacuaggccccaggccucuagcuaagaaauacuuuucaaguuccuuuagagcugaggaaaaggaucaguucgauggauuuugucuguggggguuaaguccagugagacuauuuucucaugcacgccaacagaccagucucagguaugucuuuauuagcggugugagaauggacuaauauagcggucuaaccuucuugcuuguuucaggaaagagucccacaaaaccacagcuacggagaguccuaggaagaauguaggcugcccccugugugcaugcaccucccaugcagcccguaccugggagaggaauucucucucuucaggguguugagauggaagagggaaggcgcuaagcacacggccagguugguuggggucaucugguuuucuuuuacggcugcugugacaucgcucaggaaauaaagcagggucugcagaaccucccgguucucgucaggcagcagcaugauggcagccuugauggccugcaggcgcugguccuugggcacaucugcacgacaccagcacuuucuccaucagcuuggugaauuugcauggacauugcaaggaaaugucccagagcaaauaucggcaucaaauaccucagcccaguacugaacaagcacuuguagaaagugcacuagagguuaauacgguaaaaguuaugaauugccaccggcgucacuauccucaaguauuuccugccucaugaaggagugaaaaaauuuuuaaacacccacaauacccaaacacucuuaaauccaccucagaguucggcucuagaggaugccugcucuuuuaguuuacagaacaguuuuuucuuuccuaagcaugaaaaaaaaaaaucccuaauuuaucaaucucaauuacugaaaacacuauacacuuuuguuuaguguugaugaaaaaucuuaucugagauauguacaagaacguaagaacagagaucucucagccuugaguacaaaauguucaguaucucuggagauuugcaugaguuuaacugauuuguuccuucuugaagugggaaaagcugcuaaaauauucaguucugaauugaacugaacugaaaauauucaguucaguucaauuaauaaauaaaacacacugaauuaguaauuucuuaaguuuuagaaagcaugcucgagaggcuauaaaaaugcauaugaauaugcaaauauauaaaaaugcaaauaaacccauaaacaaucuacagguagaaaaugcugaucccgaucuucaggucuccuugaauacauaacucuuuaaaagagcaugugguggaaaaaucaagucacucaaauguagcuccauaggacaaacugauuaaacagcuccaugguuacagcacauaacaaauaccucggugaggaaaaugugaccuguguuuuuauaaaauaugaaaggaugaaacaaccaaugaaauaauccagaccagcuccauuucucauaaaauaaaguccacugugccaauccuagagacaauuugagcgcuaagagaggcugcuuuuaaauuacguugcuguaauaccacacugagccaagaaaaacacaaggcuguaaaagccauaauccugaucuugaucauuaauuucgacaacuguuuucuuuaagcuuuacauaaaaguaagaagggcauggguauuguucucccaaguauuucuggcagagacugagaugaauaacagaaaaagauuauuuauucauuuuacagcaagauaaaacacacagacaccugugaaauuuuaaauccaacggcccuccaagaggggugugaagcaacugaaauuucuguagacaagguggagacagaaagagaucuucguaccugaucuuuaucugaccagcucagauaacacuguucuagaaacuaaugaaagucuaacuuuucauuuugcacguaaaaacguacaauugcaucagucauuagagacugggaaauuuauuuucacaucauucaauaauuacacagaaaccuguuccacaaacaaggcggcaaggaagaaggugaugacauggguuuccaagaggucaccaugcagacucucuugucaaaagaacgcuaucaaggccaggcgugguggcucacaccuguaauccuagcacucugggaggccgaggugggaggaucacuugaggucaggaguucgagaccauccuggccaauauggugaaacccuaucucugcuacaaaugcaaaaauuagccagacgugguggcgcccuccuguagucccagccacuugggaggcugaggugggagaaucgcuugaaccugggaggcagagguugcagugagccgaggucacgccacugcacuccagccuggaugacagagcgagacuccaucucaaaaaaaaaaagaaugcuaucaaggaagcuacaagcuucaguuggucccauuuuuccccaaugccaacaaucuuaagaucaaaggacacucacauugguagaucuguagaaagguuuccgagaguuuguucgucauuaguggcucaggaagaucucgaaaauacugcuucagcaugucugccacgucauaagcagacuguccuucguaguugacacagucuauggcaccuucauucaucuggcgcagagccugaauccgggacuugacccccgauuuucugaagagcccaaccugucggaagagcaacacuaagugugggguacauucacguggacgcaguguuuacaccacacaacuagaagaagcugcauguaauccgagcuccccugaguacguggacccgcaggcagcgcucucaccugauccaaacaaugguuccggagguaucgcauggccugcuggaugcucugaggcaacgguuguccugugcgcugcacguugaccgucagugggaccccaaacacacuccgguccuuguagucuggaaccuugauccucuucaugaacuugggcacggcccuguuaaagaacacagagauggugguguuggcggagacaugcucacuugucugucuacacuuguccaauucugcaggcaaacccugugggcuccagaucugugcuaauacgguggcuacuuaaauuuaaauuaaacaaaaugacaaauucaguuccccagugguacuggccacacuucaggugcuccuucaucuuuugugcucaguaccuacuguauuggccugugcagauaaagaacauuccuaucauccagacaguucuccuggacagugcuguucuagaucuucuaagaguggggguugacagguccguuuccucaguuaggagcguccuuccaccuugaaccuggagaauuggggucuacagucuuaaggaagcugauggauuuccuuacagaauggcgguauaggaaggaacaagcagaaaacaacauguaauacccuaauuaggugcaucugauagagugugaaaaacaaggucccuuuugucuugaaaaaaggguaagaaucacuucugaguucuugaugagaucgaaagcauuuaggguuaaaaggcgcagauaacacaugaugggaaaacagcaaugagagccuaacacaaugggagccaacuccagagcucaacagugaaugaccugaagucaaaauaaaaucugcugcugaugacccggagaacauuacaucuuuagguuucuaaaggaagauggaaaaggaacaauggggguuuugugagccgaccccaggcucccugguguccugaaaccagguccaccccagcacuauaugcaacagcaggaaacccaugucaugcauuucaggcugucaagcagaaauuccagcucuccaaaugaccucucugaacaggacccgaaagggcaaggccaaacaggaaaagaaccuuguguaggauuccucccugcuccacagaucccaccaugugaggcuuuuacaguugguuuugagucacuggaaacacugaccagaacucaagaaguauuauggacuuucagauucuugaggguuuggugggaugggggugggccacuccgaaaugagaaucuaaaauaugcaguuuuaaauagccagcagggaaaauauuacucuaagcacagaggaacuccagagaagacagacugcuuugccuuuugaaugcucaccagcagccauggcauguuacuguuuauagcuccaggaaagguaaaacgaaagagcaaaguuaaguuuguauuuccauacaguuaagugugugguaucauggcuauaagugugcauaauacucgcuuugucgggggagaaaagcccgacggcggaaugugaaaagaacacauuacgauccccaccgagaaucugaagcaugugaggauaaaccggucaauacuuauuucugucauucagaacaaacaacuucuguauuuagcaaggcucacauaauaacagccuuugaacgggaggugcuuugaugcugaaguuaaaucugcuaugaguccuaaggagaggaggagcuggagacaaaaagaacaguuuccuugcuuugccgacuuucucaagcaacuuggguuugcuacagagugcuacuaaugaaaugggcggcuucuccauuuuuaucaaauaugguagugugcgacuggauaauaaacacucagauuacugaaaagacuuaaggauucccagaugacacugaaaaaugcacugagaugucaaucuagaaacauuucucugcuuggcacugauagcagaaaaauuaagauguacccagauuaggugauauccaugacccaucuagccuuacagccuaccccucacauucuauauacuaaggagcuauauuuuucaaaguaauuaugaacaauuuguacaaugcauuucaucucuacauuugagucuauaauauguuagaguagugaauuccuuaaaauaauuauucacuguuagacagucuuugcuagaaaaaaaguaaccugaauucuuuagcacagguggaugcuacaaauauucacauccaaauuuauuauuauuauuauuauuauuauuuuuugagauagagucuuacucugucacccaggcuggagugcaguagccuuaucuuggggcucacugcaaccuccaucuucuggguucaagggauucucaugccucagcuuccugaguagaugggauuacaggugcaugccaccacacucagcuaauuuuuguauuuuuaguagagaugggguuucgccauguuggccaggcuggucucaaacuccuggcgucaugugauccaccuaugucagauucccaaaaugcugggauuacaggcaugagccaccacacccgccccaaaaugauuucuaaaaacaggcaugaauacgguuauaagaccagguacuguaaaucaagaauuucaaagauggucucauuaaaucuuauuguuuuccuuuuccuccauccaaaaauacgaucugauacugugcauacauuuacuuauaguggauuauucuuaauauugggaaggaggugccuauaccacgugaugcaagaguaaugcauucucaccccaucaacuggcaaucugucacucaaagagcugaaaacucaaucaacccacccacgcugauaauuuccuaagacuccacuggcuucaacaauaucaaauguggccucaagaauauagagaguggcuggcgugguggcucacgccuguaauuccagcaacuugggaggccgaggcagguggaucucuugagcccaggaauuccagaccagccuaguuaacacggugaaaccccaucucuucaaaaaggaaaaaagaaaaaaaaaaaaaaaaaaaaaaaagcuagccgggugugguggaaagcaacuguagucccaccuacucaggaguccagccacucuggagccucaggugggagaaucgcuagagcccagaaggucaaggcugcagugagccgagaucgcaccacugcaccgcacuccagccuacguaacagagcaagacccugucucaaaacaaacaaacaaacaaacaaaaaugcagagagugauugccauaggaugacagaugaaauauauuaauaaaggagagaagugucauuuuuuacuguggggacaaccucaaggaacugaccaaaaauaucauuuucaacgacaguugacugaucauuuaaacucuuaccagcuaaaaccaugcuuguuagaagguguguauuucuccagcagggccguuagcuuuaggagugaguauuucugcagcagguucaucugggccacagacuggcaguuaaucuguagugauacagaguugaggcuuggccgaugugagcucuggaaacugugccaucucagucggugccugcgagagaagaggagaggaaaaugagugugaagccuuuuuauuugauuuuauuuauuuuauuuuuucuugcucuguugcccaggcuggagugcaguggugccaucacagcucacugcagccuugaacuccucagcucaagugauccuccugccucagccuccugaguagccaggacuguaggccugugccaccacaucugacucauuuuuuaauuuuuuguagagauagagucucccuauguuguccagcuuggucucaaacucuuggccucaagugauccucccaccucggccucccaaaguauuggauuacaagugugagccacugugccuggcccaaaggcuuuuuaauagguagaagcaacauuagcaaugggcugcuugcuggcaucuuaucuuaggaacugauaggacuugauuucuaucccaugcuuuaauccccauuaugggaaaauauacacaauauaaagugcaccauuuucaccauuuuuaaaugugcaguugaguggcaccaaguucauucucauugugugaccaucucugccaaccaucuccagaacuuuuuucaucuuccccaaccggaacucuauacccauucaauccuaucgauuucuuugaauuuuggugcuuccugguuugacaccuuccuuaggaauggacauggcuaagaaugccagacuuaaucccauuucuucccacagaacaagcacaggcaaugucuuucugacccccagugccccacacccggaggcaggagaaaaguucuuaccuguuggaccugguuagggaagccccaaccccagaaucccuucuuuccgggaucucggagggcucuuccgguucauucagggaguugccugugcuguccaggucgcugggugugguucggucguuguccacauccagguguaucuguuuuggagaggacgggcagggagagaccgaguccagggcugaguccgaaucucccucaucagaaaacuucuccgaccacugauugacuauccgcugcauccccuucacgugguagaggaugucguccagcucggggaagauguccucguucuccagauccgccagguccccugaacuggaguagaggauggagcccggcacguugucguagaugcucaggcggcugcucauggagcuggaagaauugcgucucuucaguuccuuggggcugucgcuacuguuuucccuccugaggcugauguggccagggccguggaagcuucccguccuccaguucacagagccguuauuccccgagggggagaaacugccauuggugagagcuuuggggaaagugccaggcuugugaucuucagggauguagaacaccguguccucuggguagcucucgcgguucuuaaaguucugcuccaccacguuguuaaauguugacugauugaaaggaucgaagcccucuaaguacaugcccacccgcuuguugcacgcacugaggcuccggguccucguaacagggcugggcgugcugaccgcgcugcuggucuccgacuggcugcugcugcugcuggucugcguggaguuggaaacgcuccucuuucguaccauggggacguugaugcgguugccauugagggcggagaucuccacgcaguugagcugcuucagcuucuccucauccauccccucuugcaagaugggcccgcugaugaucaaccccagcuuugagggcgcuuugugcuugcugugaugggagcucuugagcuucaggcucuccauccguuucagcagacugcgcgucuuggacuuggcaguuuuuucguggccuuucaugcugaagcugaagcuggacaguuccuugggagagggcaggcugccgaaagagucgucauugccugccaaguugcuggaggagcaaacgcugaugacggaguuaguccgggggguggcagcauccucgcuggggggcgcguggcuggggaggcugccagugcugcugaggcugcggacggaagacaccuccuggcgcucgcugagguccaucagcgugccuccggggcuggggccguccuucgggugggagucgucuggggacccagggaccaggucuuguuuuggagaaaagacaucaaacucuucaagccgggaccaccucuugcugucccuuuggaaaguccauuugccacugauggcacaaggcucauccucgucugaaucgucacucugcaaagacagaaaggagccauucacacacuggggcuggcagccagcagggagcagggcaugagcaggaggcugcucauaauaugccaguaguaucaauuucccccuuguacuucaugauuuuaauuuuaaaguuuuuuuuuuuuuuuuuuuaaaaauagggucucacucuguuguacaggcuguauugcccaggcugauucugaacugcugaccucaagugauccucccaccugagccucccaaagugcugcggugacagggauaagcuacugugcccagccccacuuacauauucuuuuucuuuuuuaaauuuuuuguagagagcaguagucuuacuaugcugccuaggcuggucucaaacuccuggccucaagcgauccucccacgugggcuucccaaaguguugggauuacaggcaugagccacagugcccgguguuuuguuuuguucuuuaaauaacaaagauguauuuaaagaauuuaacaggagagugccugaccaaauguugcaaguuaaauaagaacuauuuuauggaaacucugggauccauaggcuguucuuuaauugcucauagaggaaaccucugagauggugaaaauuccaggcaugcaaaauauuuugaacugaagucagcaaugagcaggacugccucugggcugccuuccauugugcugucuuuuguugguguauguuuauauucccucuugcaauuaaaaagguaguuuucaaacacuaagaagaguggcaacuuaaaucucuagacacuaaaaauguauaaggucucccacuggaguaaaggggcccuggaucaaggugggucaucaagcagauucaguccacuaucagugcuuuggagacucuuaccaguaccuuuucuuccccucccccacaagacaugaaggcuagcgcucaggccacagcugaccugugaaguuucaaccucagucaugcuccagccaauugaacaaggcuucacaaauacccagcccugacagcucgcggcauucauaaacacuaaggaacgucuuugcugauuaugcccgauuuauguacaggacucagggauaagcugucacacggacuauugcaucuuggccuuuucggcaggauaucaaagggcacaauucgguaugauacaugucuuuuccacugguguggaaaauauccuguggcccaaguuucacaggacaaugaguggcaagcauggagcgcuggcuucuaggacucuucugcauagcucagugggcgcugagguuccaguucauuuguuuaaaagcuuugacuccccaagaaggcaacuuuuugcagcucagggauucuggcauaauuaaaauuugaacccggaagucagaaauauguucuuugaccagacucauuccuguuuacucuaauuugugacacuuacucccaguacuacacccaccucuucuccuaagaucucauaaaaagucuucacaacucacacgcagaagaaaauaccauccagcucgguuguguaccaccauuugacuaaacugugugggaucuccugccuucuccucuuccucuuccaauuccuuuccucccuccaaaucucuuauuauucuucaauauugcacaaaucggccuucgcuuucaucucuacagcuuugaagcacaguuauuguuauauuugggaagacagaagaguuggaaauaaaccucaguuuauuuccucuaugagcaaugcaaaaauccacugggauuccuuaagcaugaucccuuuauuauguaauaggcauugaguuaguaauuaggcaaaauaauagcugaugugaucaggucaaaaacaauagauaaaauaauguaauggacuaguugcaacuauuggcuucaacuacauaaggcuaucaagucuaggcgauaucauucaagauguagaugcuuacggaacaacaaacuaagaguuggagaaacaaaaccuauuacaaaacacaucauucacuuuuuuguuugccccuuuucccccucauucuauuaugcaauuuguauacucacucguuuccgaugaggacuaauuucuagcuucaucaccgcacauuuguuuaaaguauuuagacgccuauagagcaaagaaauaacguuagcaaagauaggcaaccacucucuaaugaguggauaaacaccuguuuuuaaacaauucauauauuuaaggaguuucuugaaacucaguaauaccuaauaccuagaggaguauuagaaacuuauuuaaaaagugagucauuuaaaaauaccuuggccgggcgugguggcucacgccuguaaucccagcacuuugggaggccuaggcggguggaucacgaggucaggagagcgagaccauccuggcuaacacggugaaaccccgucucuacuaaaaauacaaaaaaacaagccgggccugguggugggcgccuguagucccagcuacucaggaggcugaggcaggagaauggcgugaacccgggaggcggagauugcagugagccaagauagcgccacugcacuccagccugggcgacagagugagacuccuucucaaaauaaauaaauaaauaaauaaauaaauaaauaaauaaauaaauaaauaccuuuauguuuuguaaguuuuucacuuuaauuuuuauauuuuagugugaaauggcacacagcuaugauacugucaagucucucugauucuucaacucucaaugaguuguucuuacuaagaaaaaucauucuuccaauaacucuuagguugagccauuauggacugccgcacauggagccaagaaagaaaaguuugugacucggcacgguggcucaugccuguaaucccagcacuuugggaggccgaggcaggcagaucaccugaagucaggaguuugagaccagccuguccaacauggcgaaaccccaacucuacuaaaaaugcaaaaauuagcugggcauggucgugggugccuguaaugccagcuacucgggaggcuguggcaggaagaaucgcuugaaccugggaggugaagguuguagugagcugagauugugccacugcacuccagccugggcaaaagagccagacuccaucucaaaaaaaaaaaaaaaaaaaagaaagaaagaaaagaaaaguuugugaugucuccuuucauagaaauagaaacagcaaaacagcaacaaagaaccaaguagaguuuuuggcaaaauaaacagugucuuguauuugaaaucaaaacucaaauuuaaaaaauuaguuuuaguuaucuccgaugaaucauaaucuuggacagccugucuaaaauuuuagaguccuugcacagaauggaaauugaagcccucuuuaauauccaauauuuagaacagcuuccuguuauaggacaauauaaugugugcuauagucacggcaaaugaucauuuaaagaauuugcguacuguaacuucaaggauccaaaucuuaccggguucaaaauuaagcacucagguaagacucuuuuugcaacagccauccuauugucauuuugauaccaauacuuucaccucugccaaacagcaauaucaauuuaaaauuagggaaauuuaguuucguugaaaauaaaauacuuacaaaaaaaaaaaaaacccaaaaccucauggagaaauaaugcaacaguugaaaaaagaaacacuuuaaauaugcugaacuaaacgguauguacaacuaugaaugacagcccuucaaggccccaauuuuccugccaucucccagaugaucaucacuuagucuuccucaaaugaaccuguaaugugucuguuugccaucugcuaucaccaguuuucuaguuuuuccuacgaauugcaauucuacauuuucauaagaucagaucauuuaauucacacaaauuccugggaaccgugagaccuccucagggcuuuaucuuccugauccuguucuugcuguuugccuaacaauguugaugcaacagaauagaaagcauuuuugccugccugauaagcccgauuuugccuucauaccuuaggugguagccuguuuauagaauaaauaaagauagcccagagcgccuagguucagaaaaguucucucuguugauggggaagaaaagaaaacaaauaacuaagaaaaagucugcacacuuuaaaaugaguggauauaaggucccucuauuggggguaucaauuacuuaaaugacuuacacccacaguguuuuaguucucaaaugcuuucaagauuuaaagaauccggaaugguuacaguuagucuuaggucuggguuccauuaaucaaaccuguaaucaaauagucacuugacuucauuugggcuuuaaugguugaaugguguuuauaaccaaauuuacuagccagaggccuauggggcuggagagggguuuagccucacaaacuccagauuuuagucaaacuaaaaagacccaggaggccaguucuauaaaggucaacauuaccuuuuuauguugguagcacccagcuaauggcauuacagaccuaaagcccagaguuauacccuaggguuucugugguuuucauuuguccuggaggacccccaaagaauguacucugcugggaccuuauuuccuuacagagacaguacugauaucaaaucauaguuccagcuacacaaacgaggccuacugcgggccaggcacuaugcuaggcacuuccuauauaugacuucaucuucccaacgacccuaugguacagauauuaugauuaaccuagauuuuacagaugaggaaauggggcucagggaggucacagaucuugucuaaguccacacgauuaaaacaugguggcucucaaacccaguaacuucuagguuccuuucuuuuucuucuuuuuuuuuuuuuuuggagacagucuugcucuauugcccaggcuggagugcaguggcucacugcaaccuccgccuccccguuucaagcaauucucaugccucagccuccugagcagcugggacuacaggugcccgccaccaggcccagcuaauuuuuuguauuuuuaguagaaguggggguuugccauguugcccggcuggucucgaccuccugagcucaggcaauccgcucaucucggccucccaaagugcuaggaucacaggcaugagccacugcacccggcaaucuguguuccuuucuaauauaaauauuaaugguaguaauaaaugaaagcaacuuauauccuaagggauuccucacacaguggcugauaugcugggcguaacccauccguccagaagccugggccuuucccaucccccuaaggacccucccaggcugggcuccacaggaaugugucccucuuaucuccugggcaacuucuacccugcucugaagagggaggagugcaaggcuggccuaucagagguucaagagcuucucugcauggagcugcaggaacccagauaaaagcacagcagguggggaccugggccccauuguauuaaaaguaaaaacaagccaaaaacaaagaagagaagagggagaagggggaaagauacaauuuuccaaguaagacucucacaaauaaaaaugguuacaauucuuaaagauauuuucuuggaaucugugcaauugcuuuaaaaaauuacaugcuacucccagccuuuucuuuucuuuuugagacagggucacucagguuggaaugcaauggugcuaucauggcacauuggagccuggaccuccugggcucacaggauccucccgccucagccucccaaguagcugggacuacagguaugcaccaucaugccuggcuaauuuuuguucuuuauuauagaaauggggucuugccauguuucccaggauggucuccaacuccuggaggcucaagggauccucccaucuuggccucccaaauuguugagccacugugcccggcuacgugcuuaccuuuuaacagaccagaaauugugacaaaguuaaaaucugcucuaaggugggcugcuuugcauggcucaggcaucugauggacugcuuuacaacaaagugaauacugcaggugacaguguggaaaucuauuuuucauuauacaacugucacuugauguacauacuucuuugcuguguuuauagaaggagucauuuuuaauuccaaaggaaaauagcaauuuggaauaguuuucagaagcuguaggaaggcaagcaauagaaagaacauuucacaagagguauccucguagugaaucacaguucacaauacuacgugcacaugcuucaagacaaagcgaaucacuccuccaggauuaccauugaguauagcucucauaauauuggccuuaucauuggaauugcauuauauaguaaagcuagcaagaucaggccaaagccguuucuccaagggaacagacacaugaaccccuugcagugugaauguaaaaaugcugguuagcaaucuaaauccaaaaaaucuauagucccacacuuguaacuuuugguuauugccaaacuuuauauuuaagacuaugucauuguucucauaaaacccacuaacucuacaagucuucuugcccugaguagaaaaagaagcuccuacuuacuucuugaccaaaggagcuguaagaucuguaaaugucacagguacaugaacacucuaaacuaagaauaaugcuagaguaaauacgagaucacuuauaagaucccugcauaaaauaugguccaguacaaggggaggagguaggugggaaagauuuuguaaaauguuuaagcugaauuucugcaaccauauuaccacauguauuuaaaaucaacuguucagaaaauaucaacaaggcaaagacaaaagucuauaaaaagucugucagucuagagagaacuucuaaaucacagggcaaaauuucaaauaauacuggagcuucguuauuugcuggcccuugaauuccauaggccaagaagguauuuggaagaggcaggucuagcaaaugaagugacuaucacauaaucaguacaacaacuaucucaacuacacuaugcagcugacagcucagaacuuguacuacguuuuaaagaaaguugcuggcuggucgcgguggcucacgccuguaauccccagcccuuugggagcccaaggcagguggaucaggaguucaagaccagccuggccaguauggugaaaccccaucucuacuaaaaaaauacaaaaaauuagcugggcgugguggugggugccuguaaucccagcuauucagggggcugaggcagagaauugcuugaaccugggaggcggagguugcagugagccgagaucacgccacuguacuccagccugagcgacagagugagacuccaucucaaaaaaauaaaaaaauaaaauaaaggaagcugcuugaaauacacccgauagaggucccuuuucuucugaacauuuguuuaggccucucgaaaggggcaucauuuucaugaaaaguccauuuauguggacauguggacaagagcccugggguuuuccauuacaaaccaguugaugacuauuacugugaacucugaagaauuuccuuuuuuaaaaaagaaaauccaacccuaggccuuucugcacauacucaaauuggggccugauaauuuaauuuuuaaagcgcucugacauccaucacugcauuuccuauaagauguuauucuaugcaggagagaaaacugaagcccaacuagcauauguggcagagucugcuucuucuaggcuuuucuuuucaccaaagaucuagcagcacagacuuauucgcuucagagaaagguggcuucucaaaagguacucagagccaguguaaauugcaaaguacagaggauacuuuuuuucccagaaauggaaaacaacauuucaaacugauauucugaaaaagcauucaagaauuuaaucaugacccuuuggccugaaaugcugcagugauauuuuuaugacccaagaauuccuaagcuauugcugcuguccagagugcccacucucuaacugcgugaaaugauguaaugcuuaaauauuuccuaagaugcaucucagaagugaccucaugcauaugcaugaucagcagugauggauugaaaacagauuaauucugcuccacagcuaagcaugaaaacauuaaaaaaaugucuggaguaguucauauuccagaugcagacuccuuccccucccgaaacugcaucugguuucauucccgaugauauaguaaugauauuacacuccacagugaaguucuuggaauuagguuucuuucagaaaauggguacacacccuguacguuucuaucagucauuuaauuggacuacaaaagugacagcguuucugugguuaagaggacuguuuguuuuuuccucucuuaaaccaugagaacuagucuaguccauacacuaugcuaaauaucccaucuaucugccccaaaccacugcuuacuuuggcugcuucauauaacacuguauuauaugagaaaggcagaaaacagaacuaccacugcuuuccuugccuacaaagaggaaagaaauacugggugucauucuaccuucaugauguuuuuccaaguugaaaaaaauacugagauggggugugguggcucacuccuguaaucccagcacuuugggaggccgagauggaugacugcuugagcccaggaguucaagaccagccugagcaacacagcaagaccgcaucucuacaaaaaauacaaaaauuagcuggguaugguggugugcaccugcagucccagcuacuccagaggcugaagugggaggaucaccuguagcugggaggucaaggcugcagugaaccaugauugugccacugcacuccagccugagcgacagagugagaccuugucuuuaaaaauaaaaaaaaauaaaauaaaaaacagaacaaaaaaaaaacaggcugggugcgguggcucacgccuguaaucccuggacuuugggaggccgagguggguggaucaccugagguuaggaauuugagaccauccuggcaacauggugaaacccagucucuacugaaaauacacaaaauuagcugggcgugauggugggcgccuguaauccuagcuacuugggaggcugagguaggagauuuacuugaaccugggaggcggagguugcagugagccgagaccacgccacugcacuccagccugggcaacaagagcgaaacuccuucucaaaaaaacagaaacaaaaacagaaacaaaaaaaacaaaaacaaaaaaacccugaaauuaaaauaauacuuaguuucauaaucaaaucaaccuaugugaguuuugucuguguauaauuuuuuucccccagaauucagcuuuuagggauuuuagcuuuugagaaaaauuagaaaggaugaaaaacuuaaaaugaguagacaugucuugaagagcuugaaaggauuaucagugucccaucaucgacugcuacagguuuuauuacuuccaccucacuaaaaccuauaagcugccucucagcuugaagacccaaaaccacaaugaucaagaauuucugacgguuuuauucaauuucucaucauuuaacugucuguugccuauauguuaaagaccaugcugaguuauuuuauagccuuauuucguccuaucauuauuuuauacgaggggaaacugaagagguugagaggagcguucuuggaauucaaaugaugcuccugucuuuauaugccaccccccauuuauuccucugaacaugcuuaauuuccaucguacccuuuuaggaaaccuuaauccacguuuccaaaccaccugagaguuguuacuuguuacaccaauuauaucaaauauggaaugcuauugugugaguacuuccuaggacagcguggaugcuauuuuaauggcaauacuaaauaacaauauuuuacuuaguuuuuaauuaaaaggucuaugaucacucuaugguuugccaauaaaaaccuaacacaauuagcaagaacaaaagcaaacaaagccuaucuuugugagaaguacuguguucuuaaaaaauaaaaaaggaaaacacucaaaacguguccauuuaccugcauagagccucaauggcaucucuguccaaaaaaucaugcucucucuugaccaaggaaauaucgauggggaacaggaaaucuaugagaaaaauaaacagauguauuuguugagcgccuaaaacccaauuugccaaauagcccaguuuaccaaagcagggauaaaacucuucagcaauauacuaagcaccuacuguaggacaccucauuccccgucaaguucuaugggacuauaaggcaauugaagccaaucgggcaucacuguccuaaaggagcuucggcuuuaaugugggggaaacucaaaauauugcuucuggucaaggagaagugguucagaacauuguuauauguuuaaacaaaucagcaggcaaugaguccccaguagaaauuauaauuuaagccacaaagacugucagaagaaugcuccguuuuaauguggcugggcuguguguaugugugugugucuuugcucacgugugaucagggaaaggucacggaaagaaaacugagccacagaaagaucuagagaacaaugaaaagugguaggaaauggaauguaauccacucacauggcaucaagagcuaaggagaauucaagauaugcuuuuuaaaaacaaauauuagcacugcaauauggccuugcaggaauugauauaacuccccuaaaaagaaagggcuagcuaugaaguugcuauagaacaacagaaucucaaauccuuuaaucuguagaagaguucauucaguucucucgagacaaugaagaagcuguaucagaacugaaaaccagagagggggaaaacagucgacucaauggaggaauuccuuucucuggacuacauaaaaagaucccuugguaaguaaauauacccaagaaaaggagagcggagguagccgcuguggaaauuuacaacagcucugaaauugccacuggauaaaggcaaguuaucacccucuuggagucccaacuaugagggcaaaucaugggccuccucaguagagugcuacuacaauaccaggaagaggagugucucgguguaggguaacccuuuggaccagaccugggugaaaucagucaucacagcaggaaacuagaaucaccacaagcuaaaaaauucucuuuggcugggcacuguggcucacaucuguaaucccagcaguuugggaggccccaaggacagaagaucauuugagcucaggaguuugagaccagccugagcagcauggcgagaccuugucucuacaaaaaaaaucuaaaaaaauuuuacugggcaugguggcaugcgggcuguggucucagcuacaugggaugcugagguggaagaucaccugagccccagaguuugaggcugcagugaacucugauuauaccauugcacuucagccuggaugacagagugagacccuaucugaaaaaaauaaauaaaaaguaaaaaaaucccuuuggccuucaaaauggcuaaugccacacaguggaacagacauggcugucagcaguuuuggagacgcagguaauuaguccugcuccagcuccugcgggugcacaacuguucauuauguuuuuauuguuucuuaugauuacugguuuuauggaaugauauggaauuucuuauucuuaguaaucuauuuucuagagauaauauaucagaaugaguauaaaguuauagucuauccuuuuuuuucugaaggcuacaguuggauuacugacauuguucccuaaaugauaauauaagcagaccaaggaaguggcuauaguccagagauuuaugaauacauaaaauuuaguaucacagaaugacauuucuucacuaauuuauagaccaagucucucuuagacaaaugauucauggaaccauuauaauggaaauagaaagacuuauagucaauggaaacuggagcacuaguaaaugagggaagacagguuguaacauuguuugaagguugugacacuguauuuugcuuuuuuuuguuuguuuucaaauuuuuuaaauagagaugcgaucucacuacguuggccagguuggccuugaacuccuggccucaagucauccucccaccucagccucccaaaguccugggauuacaggcaugagccaccauuccuggccaauauuugacucugaauacacaccaagaugaaauaacagagcugauauuaaggaauauuuuuuaauauuuacagaguauaauaucagaucuauaaauguaaauugaaauuuucauaugccuauuaccuauaugugagaaaguaacuauguuauuuuaggaauucuaaguuaguauacccagagccauauuuuagauuccuuuucuaauccaaauuaacaauuuuuaaaaaaucugguagguauuaaaugcaagugaggaguguaagaauuaaaucaguaauuuucuuuuauuugccuggacuccuuucugaaaggacuggcuuuuaaaagaugauaguuuacugauguauagaagauguucucugaacucaacuuccacuguggguugaaaggcaggaaguauaaauugccaaguacgcaaaucaagcuuaacagggggacauguguggguugguaugggguguauaguguauguacucacccagcacacaguggcaggaaaaacggggggaggcaauggcccagaacaauacgcaguguaccccaaaaguagucuuaugcuucaaaagacuugggaacaugaagggaccccaaauguaacuugugcaaaugcacccugcauuuuaggauuaggaaagaggagacacagggaauggaauugggucuuagcaaacauauauaucacaagaaagugcuaccuggcagcaaaucaaugccaaaaacgagcauaauugaagaaaacuuaguuucuaaauaggagaacaaaaggacagccacuuugguguuacugccaaugcaguugucuuuccuuaucuccaguagagcuaugaauugaaaauccaauagaaugcuggucccccuuuccccaaagcccuucuaaauguuaacagguuaaaacuucucucuaaaggaaagacaaguaacuccaccaaaauaagcaugcaaguuaaucaaaagaaauuggagauauucucuggaaugaagaaacaguaagauauuuuacacggucuaacaauaaaacaauucagaauccaucuucuuggaaaaaauaucacaaucagucuaggcuacauaaggaagaccggguauucuaacuugggaaucacuuugcuauucacccaaccucuguuugaaaguuacccauaaaauggaaugcauuaguucauagcuguaauuauuuuaaauugacuucauauagaguauaaugaaacucccauuuaaaugaacugccuaggccaggcgugguugcucaugucuguaaucccagcacuuugggaggccaagguggguggaucaccugaggucgggaguucacgaccagcuuggccaacaugguaaaaccccggcucuacuaaaaacacaaaaauuggccgggcaugguggcacaugcccauaaucccagcuacucaggaggcugaggcaggugaaucgcuugaacccgggaggcagagguugcagugagccaaaaucacaccacugaacuccagccagggcgacagagcgagacuccgucucaaaacaaauaaauaaauaaaugaacagccuauuuaucuugacaugcagggagcacaagcacuccccaggguacgcagaagcugagagaaugaccucaguauccaagcaauccccagggcacugauaagaaaaugagauguuaagaauucagcacagauccuauuuuuuuuuuugaaccauuuuucucaauugaaaaacugaaugccacagaaaacauaauauucauuaaaagacaaccuagagaaaagugaaaugccuaauuacaaauggugggaaagauaucugcaacacgugaccaaugaaagauuaguauuuagaauaaaaagagcccuuauaaaucauuaagagaagcauaaugugagcaaacaaauguggccgagugacaugaauaaaugcucauuaccaugaaggauuagggaaauggcagucaaaaucucuauaucauuuuauauccauuugguuggcaaaaauuaaagucugacaauaucaagcguugagggaauguggauacacagauugguaagagugaaaauugguacgggcacuuucgaaaagcuugcauuuuaaaauugaacauacauauucuuuauuacccaguaauucuguuccuagggauagaagcaagaugaaucauuaugcauguaccacaaaagauagaugcaagaauguucacaacagcacagcuuauaaaagcaaaacagagaaagccaaaauacccaccaaccagaguguggauaugaauaaacagugguuucuuguguaauacacaaugguguauuacacagcagccaaagcaaaugcauaacaggcccauacaguauagaagaaucuuaacaauacaauauuaagugaaaaauaaaaaccccaugaaauuacauacgacacacuacccuuuuuauaaacguaaaaauuacuuuguaaaaauguacuuuucaggaaauggaguagaauuauacaaaaagaaagcaagaaaaugauagucuucagcaugcugauuacuuuggguagggaguggcaggcagcagaugggggaguggcaugggcguguuaccaaggugcuagcuuuuguuuucagcggugggggucuugcaugcuuacaacauuuuuuuuaaaaauaaaacauuuaaacgauaaaacugcugaaaauaagucauagaucaguaauacucgcgaacaagggauuaugauuaugccaacuuuuaaaaaguggcauucccagcuuaccuucauaaagcugugcauacugggggaaaccaguugcccguagccaaucacaagcuuccuuggcuucaauuucuagaacagaacagaagaaagacaaaauuagccauguguaccucgccaugcuuauuuuuccugaauaagcuuucguuuuaugauacaagcaaaacaugacugccauagaaaauacagauaagcaaacagacauacacgcuuaauucgaaugguuuacauuuuguaugcaucguuuccaguuuuuucacguguacaugaggauguauuuucccuuuacaaaaaauagaaaugggguccugagaguaaguuucucauuuugugcugcuucugaagugcucugauuacaaacgguuaugaaaauaaggcaucaugagaaaguugaagagagauuuaauaacucauuugaagccuggccggccuauuguacuacuuuucacuucaacaaaaggccacaaaguaccuccaccaccacgcuaaaauagaauuuaucugaguaaagucacaggcuuucugacacccagggguuggguguuucaaaagccccugaccuuguguuguuucacuguugcgugaucagguacucaucagguauuaauccaguaggagaggcccaggcugucaaggaacauggagggcacgaagucaguaaaucccacaaucuuggcaggcagaaauggcuaauaaagcuucuaccucccugugguuucacaucuuguagauagaaucgauaaacagaaaggccaagagcaacugacacacuguguuaaaacucacuggagcacauauuuacaaucccguuaaaacugacucacagaggagguccugggaacauuaguuagugucucugcuugcacaaagaauauuccuuucaacucuuccucccaccuuccucaggccaugagaguacucaguuacacaagucuguucacucauuuauaaaggucucaacauugcauaauuuaugccagauucaaaucuucauuaagcaucucucucaagcaagugggagacuaauaguucauaucagaaguguaacacaucuuauuuuugucuaguaacuuuauguuuucaaagcacuuuuucaccuauuauuuccugaguuccuuggccuuugaagaaagguaauuaagcaaauccaaauucauuaaagcaagugggaauuugaucaaugaacacaggaaagagaaaaaaaauaaccugccaucuccugaugaguucuuaauacccaaacuaaaaacgauuauggcaguagccuggaaauaaauagcauggcaaaguuaacuucaugaaucuuuucagugcagcagugaaaguagcauuauucaacccaagacuuaggaccgaaaugggagcgaaugauagugacaucaguguggaagaacuucgauguuuacacugaauaaaaguguagaauuguccaaagucaauuauuugagcuuacuuuuuuuucguauguguauauccacauuuugucucagcaaggaaauaaagauguuuuaaauaaaauuauaaaauagacacuuccuagaaaacuauauugcuggaaaaacauauacaagcucaauauuuuauuuuaaaaaacaaggaaauuagacugggugugguggcuugcgccuauaaucccugcauuugaaaggcugaggugggaggaucauuugagcccagaaguugaagaccagccugggcaacauggcgaaacccugucucuaccaaagaaaaaaauuacaaaaauuagucaggugugguggugugcuccuguagucccagcuacucuggaggcugaggugggaggauugcuucagcuuggaaggcugaggcugcaguuaaccucaaugguacuaccacacaccagccugggcaacagaguaagacucuguaaccgcuaaaaaaaaaagaggaacuuacuuuugcccuaucugugugccugcccccucccacaaaacauagauauggaaagaaaaaaggcuguuugucuuuaaaaauauuuuaaaaacucauuucauuuggcuacuuagagguuauuuucauugaacagacuguuagacauugaacaauagauuguuaaaaaguaaaugugcuugcuuucuuaauauuuaacuuaauaaguggugaguaaccaaaaauucucagugcccgcccuuuuuugacgauagucagacacggcaguaggugagcccacauacaaaagccuuaauuagauaccaauucacuagccaauccugccagagcaugcuccugcuuuacuaagagaaauaguuucaugccaagaggcauggaagauguaagauacuaguuuuuuaagcaaucuuuauauuuuuuauauaauaacuuuacaaaguauuuauuuaaggucccaugugauuucagcaacacaaaaaugcauauuccugucuucuuguucucuuucuuuuuuuuuuuuuuuuuuuuuuugagacagagucuugcucagucaccuaggcuaaagggcaguguuaugauccuagcucacugcagcaucgaccuuccgggcucaaaugauccucccaccuccgccucccaaguagcugagauagaggcaggagccacugugccuggcugucucucuuauuuucuaauggcccugucuaacaaauaaaaugacuccaaaugaucauaaacugaucagaaaagcugugucaaaauagucacucuuagggccacuuaguuagaaagaauguaaacaggcaaagguuugcuucuucagcagauaauuuaauuaacaguuuauacaauggcuaaaacacaguacuccccaaacagcagagaucuagucaucuuauccuuucucuucuucacccuaaaaaaaaaugacaauuugucuuuccuuuugauaugaaaccaugggaaauagacaagcauaugacuauuuuaccaacacaaagaguccacucugaaaacuuaggcugcauucaaaugagacccuaacccacugcuuuguagaaaucagaauuggaaaacuguaaaaaguugucacauauuuuuuagaaaauggaauacuuguugaccucacgccuacacuuuccaauucauaggucaagagaaaguacuaacaauccaauguacguacugauuuuuaaaaaucaauuauuuuuauuuuuuuaaugugaaaugaaccuauaucuacaugcgagucacacaguuucauuccccgauucacaccauuacuuucucucuaaucuaaguauuaauaaaacucugggucuguaaacaacccucucuuaagagaaucuguccaucaauccuggcucaucaaacuuucugaguuacaguauuaaucuucucucuccuucacaaacuucgcuggagcuccacguguaaagaaugaggucuuagcucugugcggugacucacguuuguagucucagcacuuugggagggagaguuggguggacuguuugagcccaggaguucaagacaagccugaagaacauagggagaccccaucucuacauaaaauacaaaaauuagccaggcaugguggcacaugccuguugucucagcuacuugaggggcugaaguggaaggaccuacuugagccagagguggaggcugcagugagcugugaccacacuacugcauuccaacgugagcaacagggcaagacccugucuaaaaaaaaaaaaaaaaaaaaauaggucuaaacacccuggcaagguuuucaaggcucuccacuuggcauccaaccuaauuguucagcucccuguacccaagcacucuagccaaaguaaauuuggugcucaucuccacacacacugcacuucagugaauuaucuggccugaaaugcugaagaugaaauuucacucauccuucaagaucccaacuaaaugccaccuccuccaugcagucuucccauuuaccucucaacaguucuauaucaaugggucacuuuacugagugcuuaauacgcauaaggcccugucuaagcgcuagugcauauuaguucauuuacaccucacauugauccuaaaauguggauuacuaauaucucugagauaaacacaugaggaaacagauagagaaguaaccaccucuccuuaaaaaugagcuuucugaggccaagcgagguggcucacaccuguaaccccagcauucugggaggccuaggugggaguaucauuugaggccaggaguucaagaccacucugggcaauaauugcgagacuucaucucuacaaaaaauauaaaaagaaaaaagagcuuucugccuguauucgcagcuacucaggaggcugaggugggaggauugcuugggcccaggacuucaagaccagccugggcaauacagugagacucuaucuaaaaaaaaaaaaaacuuauaaaaaaauuuuuaaaaaugagauuucuacauucaaaugccauagugagagaaggaacaauuacuuacaaaaaugcaagguucuuccugcaagacagguucuucccuuuaaaaauacuguauguaacagcuugggcaugguggcucacgccuguaauaccagcacuuuaggaggccaaggaaggcagaucaucugagcucaggaguucgagaccagccuggccaacacggugaaaccccgucccuacuaaaaauacaaaaauuagccaggcgugguggcgggugccuguagucccagcuacgcaggaggcugaggcaggagaauggcgugaaccggggaggcggagguggcagugagcugagauugggucacugcacuccaaccuggaugacagaaagagacuccgucgcaaaaaaaaaaaaaaauauauauauauauaaaauguauauuauguaacaaauacauauaauauauuauguaacaaugaacaaaaucuaaaauauuacugaaaaccgcauauauauuauauuacuuuggacacguuuaucuaccccaugcuuguuuuggggggccucuaacacagcucugaaugugugauuuucccuucaauguauguggguggugaugugaaaauuacgaggaugauuuuuuuaaaaaacauuccccacugaacaaaaaugccacuagaaacuaaaaauacaauggaaauacaaugaaacuuuuauaccuggguuuucucuaagcaaacaacagacaaaugccguaaggaggaaacaggaaauuuuuauuggaaacagcuuuagucaaagucauuucacaaagcaguucuggacauuagauggaugagucccggacacccuuuuguguauggcugggaaccauuaggccauauuugcacauuuccuggcaugacgggaugauccugucuucccaucacuccucaacaguaagcugaacaaaaacuccccacccccagcaucauucuguggaacucuguuaucuuagcugguugagcaacaguaauugggucuaaacaagauaugauuacuucaaucuaccauucgcucuagcuucacagggggaacuuuuggauuuccucucuucugugauaauaugccaccaaaaucaggcuucgaugcaaaugguacagugaauuuuuuuuaaaaaugcaauuuuaagaaauuaaaggaauguaagaaaauucaagcacuuugcagauucccuggauucccuaaaauuugauagacauaugggcaaagauucauggaaaaguugaugcuuuuauugcuagagaaccgugucagcugugugcaggcagguggugcuuuuugauccaaaccaagaugcauucuccuccccguggugacaaagauuccuucaaaugggaaggaagauacugcuuaucaauucugaugacaucaaggugaccaauuuggcaggaauguugugcagguggauacgaugguuuuaauuacaacccaucuuuaccugauggguggguuccagagggcguucacugggagaagcaaaucacgaccacaaauacuuguaguaagguaaggaaaucuuggugacucccagcccuggauguaggcaggcauugcgcuggggaguuuucuuuucuuuucuuuuuugagacaggguuuuacucugucaccuaggcuggagucuaguggcaugaucacagcucucuguagccuugaacucuugggcucaagaaacccuccugccucagccuccugaguagcugggacuacagguguguaccaccaugccuggcuaaguuuuuauacuauuuuuuauagagacagagucucgcuauguugcccaggcugaucucaaacuccugggcucaggcaauccuccugccucggccucccaaagugcugggauuacaggcgugaaccacccgugccuggccagggagcuuuuuaaaaacaccgaccauccccuccccagguauucugauucacucagucuagguagggccuggacauuguauuucagaaaagcucccucaguuuaaaggcagccaggauugaggaccacuaagccagauaacauuucuuuguauuccuucguccuggacuuuuucacccuuggauuauccuaacagccuccucacggaacucugauaagccucaccccucccugcccccaacaaauccguccuccuucaaggauccccgagccacugggcugguuuuaugaaacacauauuucauuaugucacuccccugcuuagaauucuuuagugacuuuccaccgccuuucaaauacaauccaaacuccucagcaaagaccacagccuucacaguuuggcaucugccuauccacucaacucuuggaaggccuccaaauguaagcuugcuccaggcuuuccaaacuccuuggaguucugaggacguaccaagcucucauaccuuaagcccugaguucucucaaaugaauuaccccuucuucacuccaccaacuucucacuuuuuaauucauuuguauaucccgaaagacaacuuuuugcacaaaggaauuacagagagguuggugugaagaaggaaaagaaaaaaaaaaaucuauuacuauuuuccuuucuuuaaaggcagacugaaaacgaugacuugaaucucuuacucuuugcaauuaaaaaacaaccaacuguuaaacauacgcaguugccaaagacugguuaucaggaguuaucuauguaaaauaaauuccuaguaagguuaagacagacagcagacuucauauauuaauauuuauuaaacucuaauguuaucuaaucacaguaaagauuuucaccagcaacugacagcauuccugcccucaggugccuaaaaaaauuccaaacaucugcuaugcauagucugaaaaaaaaaaaaaaaacaagaagcuucugggagacuggucagucacuaagucaguuucuuaggcuaucuggcuuaacaauagcuaacucaaaucuacuguuagguauauuuuaguacaguccuauguuuagcuaaagcuaaucauccuacauuuucccuuucacuauuuauugauccaacuaggcguacugccagcagcucucagggaaaaucaaagacacaagcuccugacuugaagcaggaagccaaguggaaaggaaauucacaguggaguacagcgcguaugaggacccucuauccuccacuuagaaacgaacugguuuccuaagggcuauugcaagguccacguguuuguuaagcccgaagugacccuguacacgucacguuagugagugccccuuucauuggugaaagccaaacuccuaacaaugucccacauguccuggccccugucaggacccugccugccucugacugauccagccacaccggccuccucucaugcccugucccccugcucccugcaccccccgcccccgcaccuuuuugguuguugacaaggagucucaacucugucucccaggccggaaugcaguggcacaaucuuggcucacugcaaccucugucucccagguucaagcgauucuccugccucagccuccugaguagcuggggcuacaggcgcccgccaccacaaugagcuaauuuuuuuuuuuuuuuuuuuaaguaaacacaugguuucaccgugguggucaggcugguuucgaauuccugaccucaagugaucugccugccucggccucccucccaaagugugggaugacuggcgugggccguggcaccugggcccucucucccucuuuuccuguuuuauuuuuucuucuuccacaaaacuuauuauguuuacuuucugucuuuccucuuuguaagcuccaaaagggcaagcuucuuuguccauuuuauucugugauauaucccaagcaccuacaacagcacacaguaguugcucaauaaauauuacauaaagaaauaaaccacucauacaauuuuuguucuaguaaguggucuuaauuuuucugaccaggauccccaauaggaaauacauucuacauuguaacaugguacacacauauacauguauguacauguauauauguguguauaaauauaaguacacauucaugcauauaaacacgugucuguauauguaacuauuauaaaagaaguuucaaauaaaaccuacaauaagugauacagucuuauauuuuuauauauuuuuaaaugcuguguuauauaccaaugugaccaauuugaaaugcacuauucucaugcauaguuuuucuucuaagcaugaagaacuuguguacaguaggaagaggaaugugauaugacauaggaaagacaugugugacaucagagugggaggggugucccuucucgcuaguggacaaguggggucugccugggcccagucuguacuccuuuauuuaaggaagcauuaugaucuuggauaugaaacuggauugcaggagaggggauucgguguaaaggacccugaaugaaguaagagguaagcugggaagcagaaguguugggaggaaugcagucuggauuuacuacaauacagaccaaaaagcaggaguaugaagcagaaaggaaguuaucucauggaucagauggaagcaccuucugagccugguuauacaaugagcaaccaacauuauuuccucagauguaaaacagcuuugcaccugggugcccuggaguccuucugauacucuaucacagaggacaaagcauuacuguaacaagucaggaaaacaacuccaggaaagaauccacugccuagauagguggccuuaagaaaagaauuucucuggcccuguugcuucaucuauaaaaccugcgcuugccaguggcuuuguaaauucccuaaguuuuugacucuaauauuuccuuuaugcccauuucaccuucucucuaagaccaccucuagaaaggguuccaugcccgcuguuaauuuuccagaugucuuaucaauuacauggaaacauucuucuucccucaaaaaacuggaccacuagaaacugcuacaagagauccccaguuuuguaaauuuacgaaaguuuuaauuacuuuuauuuuaaaagcuaacauuuccaauuugccuuucuuuuuuccuuuuuuuuuuugagacagagucucacugugucacccacgcuggagugcaguagcacaaucucaacucacagcaaccucugccuccuggguucaagccauucuccuuccucacccuuccaaguagcugggauuacaggugcucacgaccacacccggguaauuuucguauuuuuaguagagacgggguuucgccauguuggccaggcuggucucaaacuccugaccucaagugagccauccgccuuggccucccaaagugcugggauuacaggcaugagccaccaaaccuggccuaauuugcuuuuuaagagaucgacuucuugauuugucccaugaagccuguauucauaucauagacaacacaaaaccaaugacguuugcuucugugcgugucuauagcccucuaaauuucaacuugagaggaagaaaacacuucaaugcauagaaggcucuuaagaguuuuacuuuccuuauugaucuuucauguuuacagcagcauguugucuuccaaagaauccgugacuugggcgcugaaauaccucuugaagcuuuucaucuuuucucuuuacaaaugaggaagcugguacagaauugaggugauuugcugaaggggcuaaagcuacccagcucucauccccagguuaggcccuucuugccuauuucaacagugcccucacuuguaaaucaccauacugguuuucaguccuaguaaggaauggaagcuuuggggagcuuccuuuuuaaguuuuguucauuuuuuuuucucuuauucuucugcuugagauuuggagacauacauauacagcuuucuauuaaagaacauuccuagaaauuauagaaaggaggggaaaaaggacccauuuucccugugaugugaugacaacuuaauaaaugguuuugccuugaaaggaggaaacacugggagacaggcccugcaagccuauaccuggggugaagcccugcaagugacacuuuagccauguagaauuuaaaccaauugaaauccucuuuggggaucaucuaguacaagaguuugcaaaguacuccuuuuaacacauaaaccaggaaaaggcaagcagcucacaucaaaauaugugcucuucccuggcaaaggcaacagcucuggaugaauuugagcccaugagggacauggcuccaucaggcccucuaggcuugugcggauccaguuauuuccaggaacagaaaauaucucccaaauaaucaaaaauuggcacuuauuacccagcaaaaagaggucaaacugaaaucaaaauaaacuaagaaggaaauggauacugaaucaucacaucuuucuguuucauuucaaccuggggcaggauaaaaauaaaucgcugcuacagggacacacauaucucucuauccauacacacacacacacacacacacacacacacacguguacguauuucuaguauuccacgucaaauauuuaugcaguucaaacuaugcacuaacaacaguaauuuggaauagcucauaaaguacgaaguccuuugaagaugauaacugcauagauuaagaauuucaagaaagaaaaguaucuaauuaauacaguuuuaaagguccuuauuuuucugagucucauuuuuuuuugguaaaaugaagcacguguuuuaagauuauauaauccauucccucuuuaaacuuauuauucaaggcaaaauaucugguuacaaaccuagaguaacccugucucuauuauuaaaaguuggcauacaaauaaacucuuucuuuuacauauguuagcaaagcuuauucuacgaggggcaucucccgcaacauuggcuuuugcuuuauaguucugcgauagcacaggagaaaauaaaauagugugcaaauugcaacacuguaaaaccuuaaauuagaaauaaaggugauagcaggaacgucuauuaaaaaaacugcucacccauauuuucguccauucuaacagaaaaaagaaaaugaaugaaauaucaaguucccuuaucaaagaccaaugacaaugaaaauauggcagguacuuguuaggaguauaagccaccuccagccauuucuaugucaaaccucaaagaggaaacacuauucaacuagacguucucaguuuugugccaaaaagugugagaaaaaaguaagauuugcuguguucuaggugagcuaaggaauuauuuucaccaguauugcuugggacacccagcccccuaaaugaacacuaaugaaugaacagaaauuaaucuaauggucaaauugugauucagguuccuacaaacaacuuaagaccuucauuuuguuuagacauguugacuggaaggggucugagguuccagucaacucacaugugaucuuggacuggucacugaaccucucugcaucucagccgccccucagucgggaaaaggcacugguuuuccaggcugccuuugccaaguucuggaacuucccaugaaaaugacuuuuacagauguccaagcauuacauaaaaugcccuuucugugcuauacaauuugaaaaagagaacuguauggagauuggaucccuuaugaguuuaugguuucuccagaaucaggagguaaaaaucacuucaguuucagcaucuucuauuuugucacuugagugugaggagggacacagcguggcuguggggcagcaccgugcaugggccacaggccauuucacuucugaagucucuucuuccguggcuuccuaaagugcugccagccugggaaaugcuaccaccccaggguguggaaaacuuuugucccuuaaacauccuuuagagacuccugcgaggagaaggaaggcgccuuucugacaagcuucaggaagugaccuccaguccucuccacaggacacucaaagguggggcagggcagagaacaaaauguggaugggaggugccaaaggcaucugaggacucagcuucacugaccucagccuucaaugagcuuuugauuuuuccccgacgggggaagggguagacaccaaaaggcaccaaguagagaaauguauaaaaugaaaauaagcacacuuuucacgaggaaaguaagucuaguagaacaaaaaaaaaaaccccaaaaaaacaacaaccaaaaaaccccaaggcugaugaaugauuaagagaaacugauuuccacugugucuuggcuucacuuuagaaggauguaauaguucacuuuuuggugcucaaaacuuuauuuccuuauaggcaggcauucacauauuuucagucacauuugggagaaaaguuuccuuuagaaauaauauuugaaaguacuuucacugaagaaaacauuauuucguacagucaacgcgggccagaguuuuagaaaaugguaucccagaacacucccccaaauguuaaagacagagccccaagucuccucucacuagacuccccccauggaggggacucacaaaaaauuugucauuccugcacucuaacauuacagcugccuaccuacgcacacaagccucccaggaaauuacaaaguaacuauaaggcuccguaagggccacaauagagaagucucguugcugccugggagacacuaagaaaacauaugggcuugcuggacgcgguggcucacgccuguaaucccagcacuuugggaggccgaggcgggcggaucacgaggucaggagauccagaccauccuggcuaacacgaugaaacccuguuucuacuaaaaauaccaaaaaauuagcugggcauuguggcggcgccuacuguagucccagcuacucgggaggcuggggcaggagaauggcgugaacccgggaggcggagcuugcagugagccaagauugcgccacugcacuccagccugggcgacagagagagacuccgucucaaaaaaaaaaaagagaaaaaagaaaauauauaagcuuaaugugaaggcuuucuuccuguucuccauuaauuaugauggcaaggcagaacauuaauuaugauggcaagugaacaaaacguuaagacagaguagaccuaauuagaggauccccaggaggacuccgcaguucuuaucacugaucaugguaaucccuaauaacacaaggucccacagaaggaaaagggccagaggacagaaggagcccuucucagcugggaaucuaaacccuuuuacauuaacuggaucucuaacuaauuugaagcugaaagaaaacaccgcugauggcgcucauucaacgcaguaacucauuccuauaaaacauacuucaacccuacagcacugucuuccuucaaagaggaacagccuucaccucccucugcauucauccauaugcaaaggccacagagucagaaauagagacaguugugaaagugcuccagaaaagcauguuccuucuaauuucauagccauggaaaagaggaucuuggaauugugcuuucuaggacacacuggauauuuacacucuaugguugggcauuaguucacccagacugcaacaugaaggaacguauuuuuuagugucuugaaugacguacagauuacuccuuugcauuagagccccacagcuccaaacuaagaauuucaggagcagauccugauaaaaugagcauucugagaaaagucagagauacaacugucuagacacuaaagaaauuaguucucucccacuagaucccaacucauguaauucaaaucauuggacugugcacacauuacaaaugaaaaucaccuuucuccccaggucugcuuuauaaucucaagaacaggcuuggcaugaugugggucuggaugcgagucacaccauggggccagguuuugcuaugauguuguaaagcacugagaauucggucuuuaaugauuuggcaauagccagggaggaaggggaaacaucugaaguuauuuuuacuuuuguaaaagucuucuggcuauacagggugaaugguaggguggaucagguauugucuggagucuuucagggucuuuuauuuuugcauggccucauuuccgucuuccuguugcuaggaaggagagugaagcaugagaaacuuguguugacaauacuggaccauccuguccagcacaaggcucucuuccaaaaaguccgauccauuucacccacuguacucuggaugcccccacucuucuggaccaaaucacccuucccugaauauuuuccaauugcauauuuacccgcuuaagucauaaaaauaccacucugauuuaaacauugcgucauggcuuaaaaucuccauggggacaccaagggaaacccaaguacuuauugcuguauuugaaaccaccucuuggaaucucaccaagccucugauuggaaggcaucucaacuguggccucccauauccccuuuaagucccauaauaguucuacaaauaagaguuuaaguacuauauacauuuuuaaacucacuucacaguaauagcuuguugaaucacaacaugucuuucuacuggucugguauauuuuccagaagcacccaaacaccucuuuuaauguagaaaugcucuaaacuuugcuuagucuuugcucucucaacuacaguacagaacaacaaaaaaacaugcaaacaagggcuuuagguugaaggguaaccugccuuucaccuuuacuccagagcccuaagaaaauccuucaaucuuuccagugcauuaaaauuugaaacacugccuucauaguuagcaauaguuaauugcucaucuauucacuguuuaaggaaugagugguguuucucaugaaaucugcaauugggaaguuaugacauaagucaccaaaaccacuuuucucacccacuccagggaaagauuuaaguuggaaacuauuuauccccaguccccuuuuugaacuuccaggcuguuuggugucuggugcuacucuguguaaauuaaaauaaaauaaguauuugucaaaagcaaacuuuucaaaacagccaggagagaaacucagucugcugugcuucauuuuaaacucugaacaguaguacuaaugcaaaaaguaugcaucugcgcucaggccacgcuguaaaucuggcaugccacaagaaaugugaauacaugcaaucgccaacauuuucucagaaaaugucucaaaauaacuuuugugcacacaucugcuaaccauuugacacugguuccccaggacuuuaguucuucgauuagaggggcugcugccuuacagggcaccccucugaccaucugcugccgucugcaagccaagauggcaacuccauuaauuccacacuuacagucugcaaauuauuuccaccgaggaccagucuguaguccagauggauggcgaauuagucaaccucuuggagcugcugauagauuuacauucagagggcugcagucugcuggacuauuauuuucccucaucccuucagcaaacagaauuuuggaggaaaaaaaaaauguaaucugagacucaguauucugccuucucccgagcugcaauguuuuuuccaaauacaucaucaaugccaccagccuaggcugcauuccucuaugucaccaguaaucgccgaaacaaccucugaauccugagaaugaauccauuugcucauccauauuggguguaaaaagacucacucaaaacaagacuggggaugggaaaagguggggagugggacgaagcuuucuuuaagugcagauuaaugacugcaagcagggguuuccuucugcggugauuagcacacacuggguauuuauugaacaucgggaacaggcaaccugcuaaucacuuuacuugcaugagcucauuugauccucacaaccuccccgcgcggagguaauacaguuaucaccccuuuggugcagaugaaggaggcacagcgagguccugucacugcccaaguucgcccagcuagcaggcugcugaccaggaugagaccccaccagccugaccccguguccccucucacuuuccucgccccaggggcugugcgcugaaggacgcucgcggacgcagcaaacuacacgcagcagggugcugcagagaggaggggugcaccuccuucggagggaucaaaggcucgccccaggacucuggagguggggacagcgacauggagugggggcaggcuuccaagaagcugucgccuuguuacgaaaauagucgggucgggaggcgagcuuccuuccucucuccggcccaggaacucgcuccucggccuccuuguccgggucaagggggugggcauccccaagggggcauuucagggacacgauucagcgacccaucuccgggaaaaaaaccaaaacuguguguguguguguguguguguguguguguguguguuuccuagcaagaagcacguuugcaagccacggggcuugcuaaacuaccccaacacucuccagguaccugcggccaccaaaccgagacuucccuggccaggucugaguuaauucccagcgcuuaaaguaucuuacccaaaaaugguugaaaaggaaaacaaguuuuuggugaacuuucaggcagugaugaaaaaaaaaaauuuccaagcgccacuagggucuaaaauguucccaaacaguaaacucucccggaguucacuuugauuuuggacuaagcuggugaaugacaggagaucaguacgagcgcagagcaguccccagaggaaaggaagguagaaggcggugucgccgcgccccucgagccagagccgcgagcccccgcccggcucaaggaggaaagugaaccagggcuucccuucacggguugcgaccgauccggagcccgccuggugcgcuggcccgcgguccccaggcaaaagguaaucaagagucacuccuccaaaauucaaacucccuccccaaacugcgaguccugcuauccccacaccaccuccaagaaaauccggagacucugcagaaagcguuuaaagagcacagaacaggcaccgacuugacaaggcggggugacacuuucucgcggcggguccccuccgcagcccgcucccgcggccagcccgacggcaagacgcaagucuagcuuacguguuaggaucaugguguccggcuucuuucugcacaucaagcacggcaggcggcggcggaagcgcuguggggaagucgaggcaggcggaggcggcucggcuuccgcgucgggacccacggcggcacccgagacgcgcgcccucgcgguccucaacgcauccuugcucgccgcucccugccccucgucacggccccagaaagaaagcgggguuuucuaaagaucgaaacgagggagcgcucagggaguugggcgagaaguccgugagccggcgcuccugaugcggagaggugcggccauguccuggcugggagc

SEQ ID NO: 21442 - RNA, 16719 nt, Homo sapiens
ucuaauuuaauuugguacaaaauauaccuaaagacuuaucuuuggauuuuuaauaaaauugauuuguguaaccaacaaaucaagagcaucauaagaauggcuacaaaauuuaaaaaaaaaaaaaggguaaauggugauggaauaaaaauaagcagaucaagggaagugugcuaucauaaaauaacuguagcuucaacaucuugaguaccaguuuccuggcagauaguaaacauccaaucacaagggauuuuuccugaaggguguaaagcugguuugaaaauucuucagucacagagcagccuacacaugccaauuagaaacugacagacacuagaugugcuuggaagauuaaacacuacguacagaaacagcaguuacuaagcuccucaguaguuucuugucuuuuuuaaguuucgcugaaucgacaguuugcacaacgugcuauauucugugggucaaaaccaaguaaauacuguguaaaguuggcagauuuuuccagcuaagaucaagaaaaaacaaauuuucugauaaaacagguuuagagucagaaacacucucuaaagugcaaaacugaugguccacgaucucaaauagcuaaaacuccugcagaauggaagggagagacgugaaacagggaaauaaauuacagucagugcuaguuaauuuaggaaaagggaaaaauaaaccaaacucaagucgguaaaguuuaucaaaauauucaaugauguagcuuuccccacucucugucacacacgcuugcuaacaaguauauuaaauuaaggccaaauuuaaccugaaugcguuuuuuuuuuucuuuuuauuaagaucugagauaggaacggucauacuuaguacugaaaggcagacaauaaaaugggccaugaaaggggggggaaagguacugucuauuguucgagggauucaaccagagauaaaaccuauauacaagcauguguguagcucgaaauaaaaauaaaaggacuauuucaugucaugacugcuuguuggcuuccucuucauaugcauucccugugccauucuguacauaggaugaaccagaaccaaggccauacaaaugaccacaauauuuggcaucaucaauaugaucuucaaagaacaucuaaaaaggaauuuugaagaaaaaaaaaagauaauuuuaaccaaaaggaaccacuuguaauuuauauuucagcaauguaaguacugacuguucacugacaauaaugauggcucuuuucuaugguguuccuuugaggcuacgcauuucaguucaaugaguaagacuaauguccucaaaaguacagagcucagaaaccaaagaaagagacuacaaaaaaaguguauaaaugcaugucuuuuccauuuagaccauuuuuauaagaauuuuucaucauggaaaaauaacuauuccauuaauuuaacaauacucaagaaugaagaaagccaaugauggugggggaaaaaaaguuuagguucauaaacugucuuaaaucuguaugcaaggcugagcuggcuauaaaugaucaaaccauaaagucauggacaguaaaauccaaacauucacacucuauuacuguccuugaagaagccaagaaaaauaaagauaaauuagugccagaaauccaccuuuaguuaaauaaaccauuaagacauuuuuaaaaugcaaagcuaaaaaauccaaaagguuguuucaauuaucuaaugaaacaauuggaaggaguccaaaacaaaauauuuacgugucaugaauggauaguccaaaucacuucugaaucaacaacacuacuuagcaaaacagcuuuaaugcuuucuauuaucaauacauugcuacaaaaaguuuuaaauucucagucucaauuuaaugucuaagagaaaauauacucaaauccacagcgaauuuuuccaaaagggaaaacuuauagucaagaaaaaccucacuuguuuuuugcacaaccaauuuuccuguuuaccuauagcuagguguaucugugcacaucacuuaauuacuuaggaguagauaauggguucauuuaguuucauucuuccaucccuaacacuuuauacucaaggaacugaucucugccuuuugccguuuaaggaggguuuuccuaauaugguuucugaugcaacuacuacguuggauuuauuugaucccuucggaauucaaccccccuuuuaagacucaaugcaguaaaagagccugaguucuucucuauaaaaucuucaaagcacugaagaaugacaugagcaaauaauauauuuaucaccaguuuaaaccuuaaaaggggucaugcuagaauaaaccuaauauaaagauuccuugccuuguaggaggagcaccaaugggagucagaaaagaacucuggaguucucccacuaguaauguguuuaaucauggaaguuauuagccuguuuucucaccugagaaauaauaugguuggaccuacaugacuucucagguaguuuauguuuuaaaauuguugguucuaugaugaacauguucucccaguuccuucugaacuacauuucaagaugacuuauuuuugaauacuuuuaagugugguggaugugacucauaugguaucucuaauuauaucuuuacuuaguagguacuuguugcccaaaaucuuuggccacaagauuuuuaauguucucaaccuaacaaccaacugagaaaaaggcagugaugucuucauacuucucucauuuugaaaaaggccauuccugugagcaaugaaucagauccugccugauguugugguccuauccguuccagcucuaacuguucugccaccuccuguaauccacccuagaaaaaauaaaaaauugcuugucaagaagaaaaaucuuacaaggccuaaauucacaaauuauaaacuuagacgcugaccaaaauaaaaauaaacuuuaguauguaaaggugaaucuuauaaagauuggggggaagaaacagagaaugugaauuacuaauguauuuguugaaugcggaaaaaguaucauuuaauagaaaacaagauccuaauugggaaaauguauuuucaucauguuuuagggcauaugacagguaaauacucuccuagauaugggaaggaagcagaccacauauaggguaauauuuaucaaguacacucauagucuaucaauccaguaauaauuauaaaacugaaaagcuaguauaacaccauuuuuuucauauuuucuuaaacuucccaccauccauuuguaguuuucacuuaauuuuuacaaaacaaagccauuaugaauaaucauuaagaguaugcuaaaugcuucacuaugguuuucuuaguuaagacgaguauaugcacacaacuccuuagaguggucugcuauaauccaccuauguuaauacuccuaagauuaaaaaagaaagaugagaguggaaagaguggaaagaaagaaagagaaagacaguaacagaaggaaagaaagugggaggacaggcaaggagaguaaagggaggggagaauaaguagagcgugaaggaaagaaacaccaacaacaaaacaaaaauucuucucuaacuuguuaaggccuccaccggcaaaauggcccuucugugcaucacagcuugaaacaaggcuuugcacagcaguugcuucugcgcuaaaaauagcacgaggauuagguaucguuagcagcugcuuaggagaacagaacuagaacugaauagaacagcauggcugacuauaggucaaaaagcaccuuugucguuaaccugaauuuuaacacagcagcuuacucaggacacauucagaauaucuguacuuagaaacuucccaguaacaaccacaugaugagcaauaauuugguucccuguuccugaaaacuaucauuauacagacaugucaauuaaaaaaaaagucagaugaaaacauguaggccucagcaugcagugcuuucacagggugggcugaauuucucaagcaagggauacccuacugcaaguucacuuccuggaaguccccucaaauuacacagaagucuacugcuacaaacauaaaauaaucuuucuugaaaauuucucuagucauaugcugaccauaucauguauuaaagguaaacacuggccaaaagaaagcuucucaucuucaguuaucuguuaagaccagcgugaccaacacgguaaaaccccgacucuacuaaaaauacgaaauuuagcuggguguggugauggacaccuguuaauuccagcuacacaggaggcugaggcaggagaaucacuugaacccgggaggcggagguugcagugagccgagaccacgccacugcacuccagccugggcgacaagagcaaggcuccgucucaaaaacaaaaaaagaauuaauguuuagaauuuaaaaauacauguuaugcagcgucaaaauguuacuacuaucuaggcaggaccuacacauuucccauaguacuuaacuguaacaagcugacaucuuuuggccacagaaaaaucuuuuagcuauauaguuuaauccuaggagcauuauccuaucacuagaacugacaaaauaauuucuagccaagauaagccaaaaggaaagaaaaacuuuugccacacuacuaaauacaucugcauaucgcuggccaccuuagauuccaccuuguaagaacagauucuaugcgucuugggagaaaguaacaacucacaauggcgugcauaugagagccucaauguccucagauuuguguuuugguuugugauuuucaaucuggcaagcagugacaagaaccggaccuaagccugaaauguguugaaaauucugccuucugccaagacauacugaagcucugaaaaaaggauucccuacaaauuauguaugcaagaaaaaaaaucacaugaccagauaauauaauugcauucacuguaauacuuuaaaauaugguuuaaaacaacaucccagccuaggcucgcaugacagucacuuggucugaacagugugcugcuguagauaaugccauccgaagccuuacuuugagauuuuugcagcucuucaugagguacuucacaucauaaaugacaggaaaaaacaaucgaaggaucucaaagaagucaaguucuucuucaggcaaguuagaguugguuaggauuuugauuaaguagccaaagucguaaccgcuauaaaaggguuaaaagaauagagaagagggacauauaaauacuauaaagauuaaaaaaaaaaguuuuucugauucaaauuuaagcaagucacacuagagcccucccaaaaacauuaaagagaagugcacacaagaacagagaaaacaaacauauugagaacuaugagaaaaugucgucaucuuacaguauuaagaacuuuaucacuuuauuauucagagauaucaacacagaccuacacuaccaaaccagccuauggucaauaaaauacuauuuuguugauaucugaauagagaacaccaagaagaguaucaagcugcccacagaugucucaaaauauuuuuuaaaguaacuauggaaauggagaaauaaagaugaauggaaacuuggccagaagaguuagcaaagguagcaagagaacuggcauucgguagacaaaaguaaugcaagucaucccacuuuuacauaagguggucauauacuuuauccaaagaauaagacuguaacaagguauuuucacuucucuuaaaugacuguguuaaguagucucucccuuuucuuccuucacaauucucuuccuuucaguguggcucccuaagagucauuauuaauggaaaugcugcacauggaagaagugaaggguaguaaaaaaauaacuacucucuugaucauaaaaugcaaacuccuacacucucaaauccagaacucuucucccuuuguccggccuuucgcacagcuuucugucucccuacacucccaggccacuuagacacguccgucccuugucuaccuuuccuuccaaggaccucuaacaggaagccuauaugacauuugcucacuaacauuaaaagauuauauuagcgcuuaggauuuauaaacuucuuaaacuauucuucauuacuugaaauuagaauaugaggaaaacaacuaaugauauuuaauggaauaaaaucuucuaucuugauaaauauucaaauauaucagucuaacuuagauucuaaacuccaagaagacaugaaugaacccuguuuguuuuuguucaucuuaauacccagugccuagugcacuguauuuugucagaguauuuuuuaaaugaaaggguaugucauauacaguaaaagggaagggcaauacuuuccaguucuuuugcaccuucauaucuagggaagaaaaaugacuaaaaaaaagguauuuguaucaagagucuuaaguuauguuuccuaagguacaaguucaagugcagaagagacaaaaaagaugauagguaagaaugaguguguucaguaccuacaacucaaccauuucugguuaguacacaucaaaguugcccacaugaacaguccuucacuauaaacaucccacagaucagagacagaaacuaaacaugcaggagacucagauuuaagauacaugugugaaguggaccaaguaugagaguauuaacaucuauguaacacaaugcuuuuucaaaaccuaacaaaagccaauaucauucugaagguuacuuuuagucccuggaacgucaguuuaguuuacuuagaugggaaaacucuuuuucauaccuggaagucuauuucacaaaaucggaauaguuuccuuaccagaaacacucuuaaauaaucuaguuucauaacaauaaagaauuuagaaccaccacuuauugagaauuuacuguuuauaaaguauuuuggugaccauuaaaacaagucuucaagcuauuucuucuaagggaugccuuaucacuuuaaaaaaaaauuaaaauccaucuccacacccaucccuagcauuuucuuugcuguuuugagauaguacuuaucacuaucuaacaaaucacaacgugaacuccauuuuuaaaaacugucugcccacccccaugagaauauaaacuccaugaggaaaauaauuuucaucuguuuuauucacaccuuaguuccuagaaucucaucucagugccugccauaugguaaauacucaauaacguuguguaaauguaagugaaugguuucccccguagaacauuaaaaacuaagguguagaaauaguaaaagaaaacccuggguaacaccaauuccaaauggcgccgcuggauuuaaaccagggucuuucacuuuuuagagaaccuguacuguuuccacuaugcaacaugcuucucacaggcaaaaauggaucccauauuuuaaauuaaccuuuaagcagaccaacauuagccuccuaagaguuaggagacaacucuauauggcagucaacucuuuccagaauuaaaccugaaauugcuaacauagugacccaaguaaguguggagcaaguaugagauggaaaaacaaaugccauuuucaauguagucguuuuaccuaugaaaugacaaccauuugaccccuucacagaggaccacuccagaagucauaagaaguucugcaaaguacuggguuucaauuccuuccuccucauguuuuuuaaacuggauaccagauguuguuaguagcucuauagaguccugggcauacauguccucccuggcagaagaaagagaaagacaacauucaaacaugccauuacuucaaacaagcuguucuucugcuuacaucuauaacuacagugccagaaaagagacagaggaauggcuugaguccaccuguuucaaugcuuuauauauaugcaagaaaaaugcaauuuaaauacaaaggucauuauuucagaaaaguguuucgaauaaaaaaucauucagagaguccaaaggugcaauuuuaaucuuuuuucuauuaacucuauuagccuuucauacuuaaauacauuuaacuggguuuggaaaagggucuccuauucaccaggggcuaccgucgcaaagugacagacaaguuuuuucagagacucucagucucagcagccacuguaaugcucccagauggagcugcagccauagcuguggggcauaugcccaucucccgugcucucagcagcaccaguaaggagacccaguggaaaaugucucaugcggaugaguuaaacuacacuucaucuuaaagaaggagaugccuccuuucacaaaugagccuugcaaaugccuccaauaagcaacacuguauaaaggacuguacuguaauagcaauaauuucuucugccaacaauccuauuccuaaaagacugccuuauaaaaucaagccaggaaaucuaaauauaaaccaauucuucaagauuucacuuaagccaaaaagaaagccaucuccaaccucaaauauauuuccaaccacaaauauguguaucugaaauauuaaaaguuuccaaaauauaucuguaucugaaauauuaaaacaaaaaaguuaccaaaauacagauacauuuuugagaauacgugaaaaaguguuuuuuuauuuacuuuuuaaauuguaagaauacugguuucuaccucuuggcaaaaggaauuccuauuaaacacuugacaaaucuaaaccaugggguucacuucacuugggccaaaaaguaucguuaugguuaguccuuuagaaaucaauuuauuucuaaaugucugaaaaauuacaaaacaauggaaauauuuuaaaagagaaggaaaccacaacaaucacguaaaagucagucuccccuggaaaauccuuuaggaaggguaacagaauaaacccaaugaaguaguuucuuuuuuuuuuuuuuuuuccagugaaaccacagcuuuccuaugcuaaaaauauguaccucaaaaaauuagaaucucauucaucaggucccagugcucacacugaggcaugccuuagcaacuauaagcaaugaaagggauaaaaaacagauucuucuccaggugcacaucauucuuggccauuugccaagguauagguauacaaguaguuuagaccuuuuucucuuaaguuuccaauaacacccuucaccugucuacuugcagcauauggcuucaccccauaccugcuuuacaaagaaacaucagauuaauauuccugucuuucuuuacaucuacguaugugaagaucuuucuuacuuagacuacaaagacagcuugccucaucgccaaagcuaauugcuaccaaugccuuagacgcuauuccaugccauuccucaaaggacuugucaagugccuaucuuuauccuaacauacaacuccuuaacuaacucaugaacacacaaauaugucuguguauuaucuguaaaacaaaauaaaaaccacuauucuguugauucugcuuucccuucuugagacagggucuggcugucauccaggaagcaguggcuugaacacggcucacuguagccuugaccucccggacucaagcaauccuccuuuuguagccucccaaguagcugggacuacagauaugagccaccaugccuggcuaauuuuucuauuuuuguagacaggguuuugccauguugcccgaacuggucuuaaacugagcucaaacaaucugcccacccuggcuuccaacuggccucccgaagugcugggauuacaggaaugggcuacugcauccagccuuccuucuuauggcacucucuaucuccuucuuuacacugccacuuuccuuaaaugaagcaucagcauccuuucuguuaccaccaaacccaaggugcccuguaauuucuacuauccuauugaauuacugcaaucaccaaaagugauuuuucuuuuuugagacggagucucacucugucgcccagacuggagucaguggcaucucggcucacugcaagcuccaccuccuggguucacgccauucucccgccucagccucccgaguagcugggacuacaggugcucaccaccacacccagcuaauuuuuuuuguauuuuuaguagauacaggguuucaccguguuagccaggauguucucgaucuccugaccuugugauccgcccgccucggccucccaaagugcugggauuacaggcgugagccaccacgcccagccuaaaagugagaauuuguuaaaaauuuguuuuaauccucuuuaucagugacauuauuuccacagaaugcuucucuucuucacagcucaucaguacuccacuucaauuuucauggauguaucaacuccaaauucaguuuggagagaauucccauacguuacaauuguaauucuuagacuuaggcaauagagagaaaacagaagaguuacaaaacacugaguuauaaagaccacgaccaacuuuccucaguacuaaaucccuagugucuagcacuguaacugacacucauucuagccaccccauuaaaaagucaauuuugaucuuucuuccaaauuuccaagauucucuucacggugcucucucuauauuaggcauuacucguuuaucuuccaaaugacuucuucuaccuaauguuuuucacuguauccuucuccuuaaacaucuccuaacaucaguguaaaucaagcuuguccaaccugcagccagugggccacauguggcccggcauggcugugaauguagcccaauacaaauuugucaacuuucuuaaaacauuuugagauuuuuuuuuuuuuuagcucaacagcuauuguuagcauuaguguauuuuauguguggcccaagacaauucuuccucuaguguggcccagggaaaccaaaagauuagacaccccuaguguaaaugguagcaaaacuugguaguaaacuuuagcagucauuuuugaguaagaaagaaaaaaugucacuuacaggcuguacuaagaaagcaguuguuacucgaacaaagguguuucuagaaaaggaaacugucaauuuuauccaaacugagaagcugauggguuaccuccuucucacguacugagaucacaauaguaucuaauuuaaaaacaauguucuaauucacuugaacaaaaaguuaacauggaacaaaugaaaugguaaagcacuaauuuuaauaaagguuuaucauuugagaaaaaggauaggaggcaauuuucaguguuucacagauguaguucuuauaaaagguuuucaguuugaguggaguacuuugcacccuuuauaaaugagguguucaaucuuuuggcuuccuugggccauacucaaagaacugucuugggccacacauuaaauaaacuaacuuaaacaacaacaaaaaaaucucauaauguuuuaagaaaguuuacgaauuucuguugggcugcauucaaagccauccugggccaaggguuggacaaguuuacuuuacaagguucuguagacugugcguguguguauagauacagguauuuuuagagacaaaguaucacucuguugcccaggcuggagugcaguggugcaaucuagaucacuauagccuugaacaccucaguuaaagcaauccacuugguucagccucccuguaccuguagugcuagcuaccuguaccuguaccuguagugcuaggacuacagguacacagccaccaugccuggcuuaguuucauuuuuuuuuuuuuuuuuuguagagacagagucuauguugaccaggcuggucuagaacuccuggccucaagcaauccuccugccuuggucuccaaauggagaguauauuauuaaacccaaaagagugaaauggagagucaggcuaaacacaguguaauuacaagccacacuacuauaccacaggcaucauuacucugcuuuuccuaagcccuacuuucguaaaauuguguauacuaaauaucuuuguuuaucugacaaagaacaggaagaaagaauucauacauuggcacuaccauuaauugccuacaguuucuuucacuauuuuaccuaccagauauuaggauguaugacacaaauguaggaugucaaacagaagaacaaugcaauauugcaacauacaguuaaguacucacucaacguuaucaauaaguucuuggaaauugcaacuuuaagccaaaagauggauaacgaaaccaauuuuuaccacaggcuaauugauaaaaacaagaguuaaguuccuacggcauauuucuggucacaaaaaaaucaucaaacuucuagauaaagaccaaaauacuucuaauauuaaacaaugaaauaaaugugagcuauauguaaauuuaagaacaauuaauaaaaacaagauaauuauuugcuccauuauucaguugaggggugaagaaagccagagccuauucuggcagcucagggcacaaugugggaaccaacccuggucagcaugucguuccguggcacagugcacucacacagauacaccuacucacucacacugggacaacuuagccacaccauuucaccuaacgugcacagccuugggaugugggaggaaaucagaggacccgggagaaaauccacauauacacgagaacgugcacacuccacucagguaguggcccgggucaggaaucaauuuuauuuuuuaugaagguuaccaugaaacaauguugaagaaaaugucauuugagguccugcuguaauaagaauguauuauuuuauuuacccaacuuaguuugcaaauaaucugccccucucuaaaaacaucuaaaacuucccuuagcuaucaagacuacuucuauuaauaauacagaaauauuauaacuaaggaaacugggugaagacccagggcuugaguuagaaugaagauucugacauaugauaaacaccagguucaaggauacuacuacuucuccuauauguaaauuaagagagcuuuugugggcugaaguggcaaccuaaugauaauacugacuugaaaggaaaacguacccaagguuccagaaaacgucuuacugcauuugacauguaaucuacucauaaacuggaauaugaaugcaacaaaaaucuucacaagaaggauaaauauuauaaaaggcuauauuucaaauugcacacaaaauuuuugaaaguaaaacuaauguaggauuauuuuuucuaucagaaguacuuucaauacccagucuuccaaauacaaaaaaagcugcagucauauuuuaaauauaacaucuuuaacaucaaaguauuuuuuuuggucccauaguaaaaaagaaaaccacgcuuuugaaauguuacguuuuauauauuuccaggauaacuacaccaaauucaccuagcaugucaccauacuugaggaaaaucaauuccuaagauuaaagaaaaaaaaaaaaaagucuggguuauacaguuauuucccacuuacgucaaauuaaauuuaaaauuaaacugccaaguugaaguuccuggaggguauucuccuugcucauucauaaaugucaguccuagcugaauuaucuuuaacaagucuacauuacaccgcaauaguugguauugauagucagcauugcuccugaauucuccaaugggucuugcaaccacaccuggaaacucgguguccuguaaaauaguuuuaagauucauuauguacuaaacagucaaaacuacaauccacacauuuuuaauuuuugaugcaaaucaaagaauccuacagaugauauucuacacauuuauauucaauuacaaaguauauuuuaacuagaaagaacaucacuuuuuagaaccauaaaacucuauaaacuuaauaaccuuuccuuaaauauauccaaaaaguuacuauacgagauacaugugauaaauuuaaccaaauacuuacucuauaaccaagaaaggggggaaaaucauaaauuccugucucccaaaggauacaugaaaugaugcucacaguauuccaaugcuaaaaccaaguuucuugaagaacugguucaaaagaggggaaaacgcccuguacuuuccaauugcuucucugacacaagguuuuucucaacaccaaaacccuaagaaaaacaucauuagcuuccuaauuucucuggcuuaaacaauauucucucuauaguccacagaaagcaugcugucaagaauugcaugccaccuacucacucuuguaggauguuaucacuucucuauguugccacucuuuaucaucugagaaaucaaugaucacuaugaauuuccauugguuaagaaaacaauuuuaguucuaaucauggguaaguacaccuuuaucaaauaguaugucaucuacaaagaaacagucauauuuuaaccaaucaacuugcuccuccccaaaguaaugcauuuguuuauuuuuauuaaaaauacugagacaaagauacaucgguuuaguauuagaauucaaacuagggcuagcuaagaauaaaaacuaccuaucaagucacuaugaaauaguaaagaaaucaauauuucucuaaauucagugcaauucaacagccacuuuauugaauacuauauguguuaugcuagguguugggagagaaaggauuaaaacacuugguuuauggagcuaauaauaauccaguggauguagaaaacaguaggguagcuaacagauauagacaguauaaugguaaagaagaaaaaucauuaacuggauagacaaucuaggcagaccaaacagcacgugcaaaagcagaguugcuuaguaacacaguauauucacagaacuccaguguuaauuaugaaaacaaauugcagaccaacaacguuucacuggcacaucugauuuuuuuguuugagaaagagcacccuagcuucugggagcucaugugguacuaccagcuaggcuuugguguugcuaggagcagaccuggcacucauagccacgcccuaauguucuccuguugaacacaauuucacaaaaguucaaccucaaauaaggccacucuguaaucaugucugaacaaggacaaaaaaauaaaaaugucaaaccacaaaaugaccaaguaucuccauccuggcuaaaugaaugacuguuccuucucugcagcuuuaaccucauucuagucucucauuuaagacuuaguaagauacccaaucacagaauuaccccagcuucccgaacacauccaauccacaguaaagcucugcuucccuuaccuuccccuaagaccaccugacacgagcccaaauccuuccuaacucuuauucaaacggcccaugguucccaugaauuccagugcguuuucccucacugcaaugagggauaaacccaaccugucaaaucacagguguauuccugauggauuuuggcuggagggcagugacaaauuuuacuuuucauggugaaauuaaucccuaaaaauaucaaccaaaaggguugaauucaagacuuuaaaauuuccuuuuccuccuuuauaugaagcguuuuaaagaucugcuugugggcauaccauagcaacguaauuauauuuucggauaacuugacgaauuuucuucaucucuucauccaaguugcaagcccaaacuucacaaauucuuuggcuaugaucuacaguugccgcuggcauagugagggcacaagggagucuagaugccaagcaucaaaauguuauacuugauugaagauuuguuucauaaaauauuuuauccuuuauuuauguaccugucaaaauaaaaaaacaauaugaagaccagauauaucaaaucugaaucacagaauaauugauccagcaggaaccuaagaaguuauuuauucaaaguucuugacucauaaaaaaaaaaaaucaaaguuuagaaaguaacuuaaggucacacagcuagucuauaggaaaaaaaggacuacaguacagauuuccugguccuaauuucaguuauuuuaaaauagcuuuuuuacacauacauacuaaucauauuuuauaacuuuccacuaauuauuuaucugaguucaacuacucugcauaaaacuuuauaaagccauccauuuccagacaaaaaaugaaaaauuacuuauuuacaugugacaagaucagauguuaccauggcaaagaugguguuuauuuuuauuccucauuaauaaaacaaccaaaauccgacuugauaacaagaucuacuuuaccggcguuuauucuaacuagacuagaggggucaaaaauguuuguaaaugcucugagaaaaaaguaacggccaugaaaauuaucugaauguucgcaguugcagaacggaaaaagaacacaauagaacgucuaaaacuuagagcauauugcaugguuaccaaagauagaugucacauuucuggucuauaaacagaguuccuguugauucuugggcagggaaauuucaaauccuucugcauuuuucauacaaauuggaaaaaaaaaaaacaagaguaaaaagagggucuuaugacugucuucuaaacucugaagagucacaaauguaacuuccaauucuccaaguagagaaacuaaaggagauccaggacaccccuccuuuauaacucucccaccccgauaggcacacacacacacauaagcacaaaaacacaaagacuuggaaagacccuguagucuaacauuguuuuccuccaccucucucucuacugcagucccagaagccccgaagagacaccaaaggccuucucauuacuggagaaagcaucuccguacugcaguuucccagagaaacgagaggacggcaccgagguauucaagccauagauaacucucuucccuggcaaagcgccagugcgaaggugcugauaacacugacuggagcuacacugacucccaagcacugccgcgugaaacaauacgaagaggugaggaucuaggccaccgcccuccacucccaauuuccgucccac

SEQ ID NO: 21443 - RNA, 157948 nt, Homo sapiens
acucaaaugcuuagaaaugucauuuugucuuaguagcaacuuuaacaaaugugaguuaauuuaugaagguacugaaaaaauucaaggacacuucauuuuuuuaaacugcugcacucaaagguguaauuguagauuagucuauucaauaacuagaacaaguuuuuagaaguuuagcuuucaauaugaaauagaugcauagauuaagaacauucaacuuuguuuagacauuuuuuacgauauucaaaaauauuuaccaaguuuguccaauuuucuuauacagcagaaauuguuacagccagccaaaauuuauuugucaaacauagauagcuuugaauuuagagaagaagagcuuaccucucacucuagcucugugagcccaugaccaacucugcgguugcaguggaaauuccugggaaauauaaacuaagaggagauacgaccuuuacugugcugucacagggcuguaaaaaugaagaauuugaagaaugaaguaggucagaggaugcaauucuugaguauuccagcauuauuuauuugaucagaguaaaauacacuucccaucacuacaaacugagcacaacuacaguugucuacacauucauauuuuugacgugccaacauuuugcauucuacaugaaacauuugguuuaaacaaaaucuuaagaauucucuauuuuguuucccaucuucccuccuguucucucccauccuccaaagauguuuuauauuaacugcuaugagauuuauuugccggucacguaauacggaggacagcagggaacaacacaagauuuaccaugccuaggggaugaauggcaaacccaacuuuggcuaaugucauugagaacaacuuggaagcgugagcagagauaucucaugaaguggcagugaaccuacauuuccauuuaucagaagcaaacauggaagguuacauacaugaugaaguauuggaaguuaaagacuuaagacacaaaaucacuaauuuaaaagaacaugcaacaugaguaucaacuugcuauguaguguacauguaaaugacccaaauauucaccucuagcauccugaaucucuucuuacuacagcuguuauuuguacagccacugaauguagauuaguaaauacugacaucacaauguugacacaugcagggagggggagauaaagcaacaguucuuccuuccaccuuuuccaaagucucaggauuaggggagguaauaaguuuuggaaagaaacugaaaugcaaccuggaggagaguuggacaagccacauuuuccacucaugggaaagaagcggaccauucugcuacuuucccaaagacaaagggacuccuuaaaggguaacugaaaaaugagcgcuauccucccagacuguuuucuucuaucaaguacugcaucaucgguaagcacugaauccuaccuuucuuaauuauacuagccaaugacuuccuuguucucguucuuuauucuaagauuucccaaaauuuguaauaucaaauccaggcuuuaguuuauuuggaaagugguuucagcaccuggaagaugagcuggcucuggggcucuggaaaaucauauuccuuuauccuugucccagagaaaaguagguaggagguagaagguuugcuuuuguggcucuggaugguggagaaagguaaaaggaaaaugagaauaaugggagggaagaagacagguuaaaucugcaaggguagaucaaagguaaaaauaagguggaaaaacccauugguacuucccuuuuucuuucuuuacacaguuaguuaguuaguuuguuuuuuuauagaaaaauuaggguucuacauuuacacauagccugagaaaaugaauuacaggauaguguuaggcucacauggguaaguaaaaaaucuacagaaaaaucuaguuucaacugacauggcugaacacugaaaaacugccaagaaguuacccccaaaagauacagagaauguauagacagggacaagucaaagcucuuccuguuauacccucucccuacccuguuacagggcugagcagaguuggugguagaugaucauaauucaagcaacuauugcuuuuucuucuauggcuuuggcugaaauguauaugcugauugauugauuauuauuugauuaguacauauccagauauauucagauuuugacauuuaauacacagcagaggaggcugcaucagacacaugacacucugugacauccauuucauucacaccccccacccccacagucagacugaaaacucacaagaaggugucuguggugaagaacauuacaaagguuauaaaucuuaauagggcccugagaguuuuucccccuaugcuuaggugaaaaaggcaaugaacaagaugcucucguucuuuaagugcuuugugcaacaacguccgugucgaugccgaaaucuuuuuuuaaaucuuuuuuuggaggaaucuuuuggacggaggcaaaagucuuccuccagaguuccagucucagaagcugcgauuccgccgguggugacgcuccaguuacccuacggugaucacacgugugcugauauaccucuugugcccacguuccuccuuggggucaguccugcagaccugcaucaaaaugcuuucagagagucuguggacuuuggggaggugucaucugggugaaaugcuggggcuagggaaggagcccgaauuccuuggugacugcaaagggauggcggaggaugugggggaucucuuggggcuacacagguccccauugugcaguuuccacagaagcuccucguuuuccauagagagucgcuuguugacuuucgacuccuucuccagcgacucuugcagaacagccugcuccguggaaagcugccuugaagaaaaaggccagaaaccaugagaucuauguaaaaaaaaaaaaaacuugaaaaauuuuucuuagcguuugaaacuuuaaaguccaaaauuauuccuuugggauaaaacagaauccugcacaaggucacagguauuuggcuggcuaagaaaacccaaacacaggccgggcgugguggcucaagcucauaauccuggcaccuugggaggccaagguggguggauaacuugaggccaggaguucaagaucaacuugggcaacauggcgaaacucugucucuauuaaaaauacaaaaauuagucacgcauggugacaugugccuguagucccagcuacucaggaggcugaggugggaggacugcucgagccuaggagguggaggcugcaguaagcuaagaucacaccacuguacuccagccugggcagaagagugagaccucaucucaaaaaaauauauaauaauaacuguacuuuuugggcaauuucauaguaggcugagagccacuuuugcaaauauucgacauguuuuaugacuaccuuauguugcaggcuguuuucuauuugguuuuguguugcucuuugucugaaagcauucucagaggcagccagaggccgugggagcaggcuugcuggccugggucucaguguacaguuuucaggccgcuuugguaaaagcaugaacuacuacaaucauauuuuccacagagaaaucaaugcccuuuuaaccaucugcuuccaucauauuuccaggaggugcagggguagagcguguccagaaaguacacuggauguccaagggagcggggagcucgggagaaacagcacuguuuuauuuuuaccuugagauugccaugugcuuguccauccgagcuuucaauucuucauucuccugcuggaaacgcuucaauuugucaaccaaugcuguguuguuguccaccuuggcauaaacaagaauuccaacauuuauacaauauuaaaaaaaaaaccccucauuucuuaaggcaccucacgacacaagcacacuuuggagauuuaauuaaggaaaaugcaauuccauauuaaaauauuuauacacuaacaaacauacugaaaaagauuuuaaaacagcaaaacagagcggcuggguauuuuuaaaacauguaugccaggacacuuaaauauugauacgaguggguaacagauuuguuccaggucauguuguuuuggaauucucuaagaauuggugccucuuucuguuucaaugugaaauaaacccugcagacacacugcccacacuuaucaaagcuuaucuaucuccuuacggugaauuuugcuggaaaaaaaaaaaaaaagauucccacaucugaugaaaacucacaggccagcaauucacagucccuggcaacguuuacuauggacuugaacucaguuucaugguaaguuuucagcauuugcgucugaguggccauacaaagcuucaauucgauagagcucuuagagcaugccaucaaagaaguaacaugccacgagucuccucaggucagcugaagauagauaggucuguucucuugcugcccugugcaggcugaacuuucaaggcaaacaaacugaucagcggagagaugaaaggauaagaugccugaggacauuuaaucacuuaacaugaugaagaccugauuccaucccccacucacuuucuaaagguaaggcuuuaugaagaggcaauauuauagcuccgucaggauuaagucuaaguccuuguccuuguagcaggacuaacgcgcuuugaguauguugcuuaguuuggaaccugauuguucuuaagacauccuguuauccagaagcagcucaggacaaccuguucagguuaaaucacuuuccagaaaaggagucuacguucaguaauuaugaaggauucccagauaaaacaacguggaaaaaaaccuggaauuugagauugggagguauuguccuuuaaauaucucauccuagggaaacuaguccuaauaaugucacagagcugauuaugggcagugccgguuucaugggaaagcugucuuucuuagaaaacuuccugugcuucuaagucucuuaauuucaucagaggccuguaauuuacaaauaugaagggaacagugggucucccucucauuguaucaacucauucuugcacacauacacaaugcaaggcugaaggauauuaucaggauaccucuggggcauggcaagaaacaaauaguagaucaucagaaauuaaauguguugguaaguuuacagcaaagucugauuuauugcacaugauuuuuugaaaguuuugaugcaugaauggcauauggagcaguccuauuaacaggaucaucugagucaucccugacuaccagauuagaagauaccagacucagucgaacaggacgaccuuuggcaggaacugguauguauacuagguuggcccauuaacaaccaugaguuccuuuccuuccuuuacaaaaauuuccugauaauucaaaaugcugguauauccacacaggggcuuggccguuaucucccucaacagaagucauagucuccagaagaaaaccaaacgccaaaccaacacaaaccaagcagcagagaggucccccauguccccuacuguccagggcugguuuggguuugaaugaggcacuuguagaagccugagucacucaucacuguggggagaagaggccaguagcaugcggcagcuggacagucaacagcaaggcaccgcgagggcggggaucacuuaagcugccuugccaaacucugccaacuugguuagaguccuggcuggcagcagcuguauuucagggccgggccaagacugacgcugaacacugaacaugccacucacacuaacaucguucucuguucuagacacugcaaagugaauguuaauucauauuuuugguaacaccugcuacuuguccaaauggauuaaucuuauuauagcacaauuuuuuuuuugagauggagucuugcuaugucgcccaggcuggaaugcacuggugccaucucaccucaauggaaccuccaccuucccaguacuugggauuacaggcacccaccaccacacccggcuaaguuuuauauuuuuaguagagacaggguuucaccauguuggccaggcuggucucgaacuccugaccucaagugacccacccaucucaaccucccuaaacugcuggcauuagaggaaugagccacugcgcccagcccacgauucuuuuaucacaugcuaauucacaagaagcaagaugaagaauuuugauaaauaguauugcuauucauuucuauuaaauucauuucuauucauuucuauuaaacguauccaacuguuuuggaucuaagaaaccuguccaggguggcugguauauuaaaguacugauuuuacauagauauuuaaacauuuuucuuaugcaggugaagauccaaaauaccacugaaauauaagccugauuuguuuguaguuuuuccaaggacugggugcuguuuuacauguuccuugaaaaagaaaacauucuaggaggcagcaaugaauaaauauggaacaaacuuggaaagaaaaugugaacuuuaucuuuuguauaauuucuaaauaucuuuaggagcaguuaacccaacuccacaguucuaaaaugcagggcucaauuucacacauauuaccccauuuguaagauccucuuucauucugaaggaaacauaccaguuucuccauuuucauuaacuugauguccuguugaugcaguuucucauucuugaucucuaacacagcuuucaggcuuucuaacuccuguucuagauacaugaucugaggauuuuucuggaaaggacacagcaagauacugcucuuauuccacauaguucaaauucuuaacagaaagaaucuuugauuagauugagacauuagacaaguagcaagcgacagauguucaucaucuuagagcaauuucaaagaaagaggugaaaaacaagagcaccuuaaugucgaagacugguccuaauacugaaagcaaacauuucacuuauuuaucaguaacuuaauaugcaaaaaugugaguugcaucaaacauguuauuguaucaagagaaaaacuuugcuuacauacaaaacagaaucuuggcuggagaugaggcaaucugugagucaguuauuggcauuuucugggagaacagggaacaacaguucucuccuaccaaacaaacugaucaggaaagaaaaagcagugcauuauacggcucucuggaaaacaacagggauaacaauguccugaguguuuggauuuuuguuaugauggggcuacguugacugggccauacuucuagggcagacauaauacuaucauuuucuauugugacaccccaguaccuacacggcauggaguacacagccuauuuaaauuucucuccaaaaauuacaaguuugccaggcauaguggcauaugccuacagucccagcuacucaggaggcugaggcgggaggaucaacugagccaggaggucaaggcugcagugaacugugaaugcaccacugcauucuaaccugguggcagaacaagauccugucucaaaaacacaaaacucuccaaaauaaaugcuacaucaggggaggcguccucugagagcacaccaucaguguggauuucccaccaccgcccacccacuccuugcuuuauucggaaauucaacuaaaccauucaaaauuuaugcuacagaagaacagcauaugguccacugaucagauauguuuaaugaagcaacgucuuagguaagagucggugguguggucaucaagcuuaucuuccggggcauugguuucugcucuggaccaauccuuagggagaauccaggaaggggccucggggauuacuuaauccaaaccccuuacuucacacagaaagaggaaacguguuccacggguuaagcgcccuacucaggaaagaucaggaaagcuuccagagcuggaaagggucagggcagggacuaauacaucuuuaauucuagguucuuuagauaguucccugaggcuaggagagguaugcguguguauggugggaggugggguggggugggaugaggagagguugguuaaugcauacaaacauacaguuagacagaaggaauagguucuaguguucaagaacauaguagggugacuauaguuaauaauaauauauugcguacuucaaaauagcuacaagagaagauauaaaauguuccaaacacaaagaaaugauaaugaugacggauacccuaaauacccugacuugggcauuacacagucuaugauugucucaacacaucacacguaccccauaaguacaugcaaauacuaaguaucaauuuuuaaauuucauacauuuuauacaguguuacccuuguacgcaggauuuuuuuuuuuuuuuuuaccuugaaaauagcgaauccuaccucauuuuuguuagagggaaauggcauaacuuaccgucaguuuuaaaauuagagcauuuacaagacuuguacccucugcauuuucuccuccuccucugccagcccaucccuuucucccggacuacagucagacgcacucuuuuuccgcagccucagcaugcuuacgugacagaagcgguuggaugcuucuguguuccucacucugacucugccuuagcuuuucaaaagcggcugcaguagaagaauccccuuuguguaccggaagcucuuucaaaccuguuuccugagccaucaauaaaguuuauacccugcauaucccugcauguaagucuagauuucuuuugaaaucacugacucuuccuaagaaucuucuagaauaaauagcuuugaaguuucuuugaauauaagcucaucuaauguuaucaaauagcuagagggucucccaaugacauuauuugcagaaggucucacugagagauccacacauguacuuucuagagcuggccagagauuugaaguggagaaaagcuuugcuucugcagucucagaguauaaacaugaaaugaaaacagugguacuaaaggcagaagcagcaaggaaacaaauuuuuuucaaaaagacaaagguugggguaaggcuggggaaaaaggacaaaugugccacaagaaauuucagcuuccaagagauuuguacuuuucagaauugacauuuauccauacggcgaaauauuauucauccauaaaaagaaaugaaauacuaacauaggcuacaccacggaugaaccuuggaaacuuuauacuaaguaaacgacgccagucuuaaaaggaccacauguucuacaaucaaccuuuucuauucauuccucagaauaaguaaauccauagagauagaaaguagacgggggagagccuggugcuggggaauuugggggaauggggagugacugcuaauggguccaggguuccuuuugggggugauaaaaauguucuagaaagagguacuggugaccaauggacaacuuuaugaauauacuaaaagccacugaauuuuacauguuaaaagagugaacuuuuccugggcaacaugguaaaaucccaucucuacuaaaaauacaaaaauuagcuggccauggugaugcgugccuguaaucccagcuacucgggagggugaggcaggagacucgcuugaacccaggagguggacguugcagugagccgagaucacgccacuacacuccagccugagugacagagugagacucccucucaaaaaaaaaaaaagaaagagugaacuuuguaguuuguuuuaucucaauacagugauuuuuuuuuuaaauaaagucuucacauaaaacucuaauccuaauugguaguuuccuucuuuuuagcuuagaccaccagaaacauccuggacuucauccguaugucagauuuuaggaugguaaaacaagacgccaguaagcaaagcaguuguuuuacacaccuuagaaagcacauugccagacaugagaaggauucccaaccuguguuauuucucuggcugcugaguacuugaaugacucuaaaaggcaacugagaagaaaaauuccauacugauaaaggagcacacacaacuuaccaaauuugcuuuuucucuugcucuucuuuuuuguucuucugauuucaauuuuucauuuaaagcaucauuuucacucuucagaucauugauuugcuucuaaaacacaaugaaauguggaacuuaaguuaacaagaaaaccccagaaacucagcauacguacacagaaacauuaaaaccaaacaaaaucaaaaaugauauuuuuuuuugugggggauacugggauauugacauucacccaccucuagcgauuccugcuucucagaaaguaaaucuucaagcgauuucuuuucuauuucauggccuuucuuaauuucugggaaaauaaacggauauuuuugaggcaauaacauucuaugagaucaauguacucuaaaacaguuaaagcauauagauguagggguugaugaugaagccguaugacguuacuuuacaucuauaguaugcuuuuauguaaauuggccaucuguucucaaaauggccuugagaggugguuaggguagacauucccauuuuaugacugagagcccugaggcccacugaagcccaccauggcccacagaggccaugcgaccuuaggacaacacugagugccauuucagggcaggcucucauaaaugccacuccagacuccuggucuggaaacccugugcucuuuucaauuugcucuucauaaccuaaacauaagucuaaaauuauacucauuucuagcaggaaggaagaaaaacaauguucacuacaagucugccuggagccagucacuuuuacacauuaucaccucugccugacuuugggcaacucuauuuuuguggugagaaaguccuugcugaaggucacacagccgguucuuagcacucauccacgcugcucuguaagaugcaacugguuuaguagaaagacugugagcgacacugccgauucuguucugaaagcaauggcuuacacccucccacugaugacagaugaaaaauagaaaagacuauuuuucuauucaauaaguggcaucgacauuucacagcaacacugcugugcaggagcacuugggguggauccuuuacuguggauuacaagauagaaacuuguacuugccacuucccagggaccuaagcuggcaaccaccaccgccaaaauggccuuuacagucuuccaaagcccauccuauuuaacacaaggcuggcauuuguaacuauuauuugcauccuuagugggaaaaggcaucuguuaacaauaaaccacgcaaaaaggaaccaagaacaccccagccugaaggccacagggcauucgcugaagcaggaaguuaugaaucauuuccaucuuaaaacaucaugugguuccuucagauuuuauucuguuuaaagaggaaaaaaagcauccuugccugaaagggaggcuucauaggccuucuuuagcaauucaaguuucucugaguggcuagcuucaauuuccaacuuagagguuucaugcgcagcauuuaaguugucaaacuguaagcaacaaacaaaaccgugguuuaacaguaaaaccaaauguccuaaguugaauacgcaaagcaaccacauuaggagacgucacagcuucacagguaagcgugggcucuaguuuaaaggcuccucaacacauacaaaggucagggcagugguucacacuuguaaccucagcacucugggaggcagagguggaggaucacuuggagcccagcaguucaaguccagccugggcaaugucgcgagacucuguccccacaugugcacacacaaagaaugcaugaagagcaacgcaacugggauucaccgcucaacucuccucugucuccuucccuacccucaggaacacagacacagaggcucuccagggugacagauggaaauggcugcaucagucacaaggaaugaccaggaacgaggauauguuucacagugacagggccacaugcucugcgccugucacuugaccacucaggcccuagcaugugccuggccuggaguaggcacucuguagauauuuacuaaaugaaaaacugaguuaaaaagggagcuacaaaauuaaaaagguuugauauuuuauucagugaaaaaaaaaaugggauauuuaaacagaugccacuaaaaaaaaaaaaaagaaagaaaugcaaaacaauaguuuggcaacacaccaccaggauguuuacaagggauuauuucuggguagaaagaaaggguuguuuuuucaauuuuaucuuuuccuccuccuuuucuucccuucuuucacuuaacauaauacauuccuuuggucauaagaaaacuauucaauuaaaaagauacuguuuccaaggcaggcggaucaccugagguugggaguuugagaccagccuggccaacauggugaaaccccgucucuacuaaaaauacaaaaauuagcugggcauggugaugggugccuauagucccagcuacucaggagguugaggaaggagaaucacuugaacccgggaggcagaggcugcagugagccaagaucaagccacuguacuccagccuccagccugggagacagagugggacucugucuuaaauaaacaacaacaacaugcuuuuuauaccuauuagacuaaaaaagagaagcucaucaagaugugaagagcaaccaggauucaaguaagcagcagaggccucagacaagcucuggcugcaaaagcacagaccugcucuugcaauugcauuuuguacuucucugcuucuucaauguaagugucccgaagcuuuucauacucccugguguaaaacucuuuaagccgauucucucguucuguuuuuucagccuggugcugcuggacgaaugcuucauacacuguuuguaacucauuccuggcuuuuucuaauuucucacaggugguugaagcagugacugaaaacagaggagaaagaagagggaagaggucauuuuauuugugaaauguccuauauucauuacagucacacacagcugugaugacaccugaagcauacacccaugaugucuugggucucuagugaccaugucuucaaauauaacaguauggaagugaacuguaaaaaggaacacgagggcagggcgcaguggcucacaccuguaaucccagcacuuugggaggcugaggugggggaaucaccugaggucaggaguucaagaccggccuggucaacaugguaaaacccugucuaucuuaaaaauacaaaaauuagccgggcaugguagcaggugccuguaaucccagcuacucgggagggugaggcaggagaauugcuugaacccgggaggcggagguuguagugagccaagaucacgccacugcacuauagccggggugacagacugagacuccaucucaaaaacaaacaaacaaaacccccccccaccccacauucaaaaaacugacucccaagcaguaagagaaguacuucagaagacccagguuucuaagagaagauccccucucauguggugaccagucaaugcaguggucaagaaaagagccuuggccaggcagagacauuucuuaggacaagcgacuccucccucucccagccagccagugugguagaagcucacacaagagcaggaaagacgagggauaagaaacaaguggaccggccgggcgcgguggcucacgccuguaaucccagcacuuugggaggccgaggcagguggaucaugaggucaggagaucgagaccacggugaaacccugucucuacuaaaaauacaaaaaauuagccgggugugguggugggcgccuguagucccagcuacucgggaaguugaggcaggagaauggcgugaacccaggaggcggagcuuccagugagccgagauugcgccacugcacuccagccugggcgacagagugagauucugucucaaaaaaaaaaaaaaaaaaaaaaagaaacaaguggaccuuaaacuuguaguuaauuugaguugauuauaauuuguuauuucaaaacuaauaaaaauaaaauauuagccucuauuaaacgcaaaucaccagagcacaaauaucuuagggaaaaaaaaacacaucuuaaaagcacccacauaggccaggcacggugguuugugcuauaauucaaguauuuuaagaagcugagaccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguagugacgggcgccuguagucccagcuacuugggaggcugaggcaggagaauggcgugaacccgggaggcggagcuugcagugagccgagaucccgccacugcacuccagccugggcgacagagagagacuccgucucaaaaaaaaaaagaagcugaugcaggagaaucauuugcaccuaggaguucaugaccagccuggacaacauagggaaacccaucucuuaaaauuaaaaaaaaaaaaaaaaaauuauccaggcaugauggugugggccuguagucccugcuacugaggaggcugaggugggaggaucacuugagcucaggagauugaggcugcaacuguugggcaacagagcaagacccuaucucaaaaaaaaaaaaaaaaaaagcaauauaaaaugaaagguuaaaaaaauuuauauauguauacauagguacauaugugcacguauauaugcauacauauguaugcaugcauauauguauauaucuauguguacauguguauauauguacauauauguaugcauauauacaugcauauacauauacauauauaauacauauauacacauauauacacuauauauauagacacacacacacacacacacacacacacacacacacagagucuugcuguauugcccaggcugaagugcaaugacacaaucuuggcucacugcaaccuccaacucccagguucaagcgauucuccugccucagccuccucaguagcugggauuacggcacaugccaccacgaccagcuaauuuuuguauuuuaguagacacaugguuuuaccauguuggucaggcuguucucuaacuccugaccucgugaugcgccugccucggccucccaguuaauauauuuuaaaagggcaaaguaaucugauacacauaauugaaaaucagaacaucuuagcucuucccuacaacuaccaaaaauagaaugacuaacaauauaauacauggcagaacacaaccaaagauauauguacacacacuacaauaaauccuagaaaaucuugaauuccuuaggaagccugacuuuggacauucccagucuucugucaccgauguguaaauacaggcagacaggguacuacuguaacugucagggauacacaugcuguccacauccccagaguacucguggauuaauacgacaggguugcuggcaaaucuguuaaauuaacccuuaccucucuuuggaaaggaauaacauaucaggaguugaaggaagaagauuauuuuagggcacagaaaaggacaauuuagaucaauaauuauuuggccuaaggaacgugaaaauggcagguucuuaggaagauuuccuacaauggugucaacuuguuaucucaggaaccugccauguggugguagaaauacccaagucacuugcccccagucaguauucuuucagaggaaaaggaggccacauugaaauaauggcaggaauagugucugccaaagagaacccuuaaaaauuaaaucaaucuacaaauguuuauugaagggcaaagauuuaacauuaaaaaaaaauccccaaaacaaaaacuauuucucguugccuggcacagaauggggcucuuuaucuuguuuaacccucacagaggacccuccuaaacauauagauaaggaaaccgccacagagaggcuaaaucaucugcccaggggcacagagcuggcaagcgugagaggauggguuucggugagcagucugaauucugauucugccugcacccaaagcccgugccccuucuuuucuaccaagcuguuucuugugcuggggcuggcaaggcgcaugauggggccucuacuggaagagacaacagacagaggagaaguggcaggaccaggccagaccuuggggcccagggaguggcacucaggauaguuuacguccagucaggguggaccaaagguuuggucagauuuuuaaaacaauuaaaaaauaaauaaauaaaaacugugaugagggcugggcacaguggcucacgccuguaaucccagcacuuuggaaggccgaagcgugcagaucaugaggucaaaauauccagaccauccuggccaacauggugaaaccccaucucuacuaaaaauacaaaauuagcugggcgugguggugugugccuguagucccagcuacucagcaggcugagugaggcaggagaaucgcuugaacccgggaggcagagguuacagugagccaagaucgcacuaccgcacuccagccuggcgacagggaaagacuucaucucaaaaacaaaaacaaaaaaacugugaugaagcagauaccaaauuaaccauuuuaauuauuuuuagguguaugauucaguggcauugaauacacuuacaucguuguguaagcuuugucaucauccauucuccagaacguuuccccccaaccugaaacuucguaccaauuaaacaguaacaacccauccccuccccuuccccaaggcccuggcagcgaccauuuuacuuucuuucucuaugaaucugaccauucaguaccucauauaccuggacucaaauaguacuuguccuguugugacuguuuauuucauuuagcguauguccucaaggcucauccaagcugugggaugugucacaauuuccuuccuuuugaaggcucaauauuauuccauuguuggccgggugcaguggcucacgccuguaaucccagcauuuugggaggccaaggcaagcagaucgcuugaguucaggaguucgagaccagccuggccaacauggugaaaccccaucucuaguaaaaauacaaaaauuagcggggcaugauggcgcacgucuguagucccagcuacucgggaggcugaggcaggagaaucgcuugaacccaagcagugcagguugcagugagccaagauaacgccacugcacuccagccugggugacagagcaagacuccgugucaaauaauaauaaugauaauauuccauugcacguacagaugacauuuguguauccacuuaccauccacggacacuuggguugccuccaccuuuggcuacugugaauaaugcugcuaugaacaccgggggacaaauacaugcccgagucccugcuuucaauucuuugguguauauacccagaaggaauugcugacucauauggcaauucuauuauuaauuauuugaaggacuaugguacucuuuuccauagugguugaaccauucuacauucccaucagcaguacuacacacaaggguuccaauuucuccacaugcucaccagaaccuauuugauuuuuucaaauauauguaacagccauccuaaugaguacaucacugugguuaugauuuggucaguagauuuucaaauuaagccauaugauagaaauaaaauugaggcaucaaggaugaaaauccuaucccagcaugagcaaugaugggcgacagaacggugagccuuggugauuaagaaacucacaaagcagagaagauagaacccaaaaagacagacggaggccagauuacaggggccaucgcacgcaacucaagccuuugggacugaauauuaaaaguuucuuuucuccuuuaaaagaauuuagugaaagauagugauggucuugacugcuggagaacauucucugcacauucacuuuuccuucuauuacacuaguaaccacagaagaaaaaaugacucaagaaguccaauguuagucaaacgaguaaacacugcauuagcuucugccaaguaacuuuccgacucugaaggcuccucgugugaaucucguauuagaacuuucuaugaaaaccuacaacagaaacauacuuugcaagccguuggugaagguaucaaauagcuucuagucagagaaauucuaguuucacgcaggcuuuucacuugcuucucuuaaaauuuccgguauuuccaaaguuaaaaaauaaaaaagcaggaacaagaucugaacccaucuggaagcucauaucugggacagaaacaucuaagugaacucagggacucagcaauaaacaagagacugccuccaagcccugggcuagaagagcuucgaagcugacguuaauagcagacuacccuggcugauuuuaacacaucuguuuaugauaaaaauacugucgcuuugaauauguaauuguggcacaucagccuuuaaaaccaaauaggauacacagaaguccuuuccuauuagccaugggacagggcuguuucccucuauucaccaaaaaaaaaaaaggcagcucugacguuuugauaagugaggugaagagaggacacaugggaagaaacgggaaagagaaagggagaaaaugggucagaugggggaacaggagguucacugcuguuauuguaauaguccaaagcagcaggcccagccccagacagugacaucagccugcagcugugcacagaccuuugcucuguuuacuggcccggugugcugcuggggaacagcugggcugcaguaaucgcucacacuaauggcuuucguuugaaggaaguggccugggcugcgaaggaaacauuuauuuggcauaaagacucaugaaguauuuuuuaaaggaugcacauguaaacgcuguauuaaagguucucagagugcuccucggcagcugugacauaaacguguguguguggcgguggggggcgugcauaaccccgauuuuaggccauggacuuuccugugcacugacuacagcuuaggagagauuuauggugccaccugugugugcucucacuccuauccucagccuagucucuucuugcucauucuccagaauuccacucacuuucaauuaaucagacaccccacaaagccaaaaccaaacauaaaauuguuucgaauuugcaacaagcaagcauggacaugcgaauguuugaaagaagguauuagacaaacacaaagucaaaguagucuuuuugucccuauuuuuuuuuuuuuuuuuuuuuuuugagauagagucucgcacugucaccugggcuagaaugcaguggcacgaucucggcucacugcaaccuccaccucccggguucaugcgauucucuugccacagccucccgaguagcugggacuacaggugcacaccaccacacuuggcuaauuuuuuguuuuuuaguagagaugggguuucacuauguggguaagacuggucucgaacuucuggccucaugauccgcccaccucagcaucccaaagugcuggaauuacaggugugagccacugugccuggccucuguuguuuuaaucauuccauuagucuauuuuuuaaaaaagcacauauaugauuaggaacaccaacagaccaccaucuguaggagaacugcugggcaacuuuuguauacauguuuguaaaccaugaaagcuaucuccagcaaucuagcuuaaaagaggaaauacaguucucaggauuuaaggaaaaagagaaaaaaaaaaaaagaaaaaggaagaaaggaggaagggagggaaggggaggaaggagaagaaggaaaggaaggcaaacucauguacaaaaacaucucuaaaauguaaggccacauugagauuagaagucaguauuuucacucugcaaugaaucacccaagaagaauucuaggccagugacccucccugacaguuuaaaucauggauaucucagcaagaaaaaaaaaucguaaucagugaaaugcuuuaaguuuugcuuuucaaguaauuaucaagaugauauguggaaaaugcccagugccacagucaaacauaaucucuggaaaacagagcuggaguccucccagguccuucauuacuuagcccugcagaacuggaguggagccauuacuuaauuaguccucauggcuuuuucucagaggggaaggucagacuuuuauuauuuccaucucacagagacucauuucccuuuguugauugauaaauguacuguuuacagagaaaagcauuacacagccauggcccgacauuguuaauauucuuuugaaaugauacagugcuuuccuaguuuuuauaucugaguagcaugguucauuaugagacgaccaaaaauauuuuaaugcucaagaacauaaauaaauguccuaauaggauagagccaaaauuacuuggguucaaaucucagucacaccacucagcugcuacaucacuugagcaaauuacuuaaacuuucuaagccuacuuuuuguuuuguuuuguuuuguuuuuuuugagacagaggcuuccucuaucacccaggcuggaguguaguggcacaaucucagcucacugcaaccucggccucccagguuuaagcgauucuccugccucagcccccugaguagcugggauuacaggcaugcaccaccauacccggcuaauuuuuguauuuuuaguggagacaggguuucacuacguuggccaggcuggucucgaacuccugaccucaaaugaucugccugccucggccucccaaagugcugggauuacaggcaugagccaccgcaccuggccuaagccuacauuucuucauuuuuaaaguggagauauuauuagucccuucucuagaagaugaaauagcacaggugaagcacucaccccagugccugaccacaguaacuuugcagauaaauuguauaacuguuacggcuugcaagaguccauugauuccaguguguuugaagacuccuggaagacaggcuuaggguuccauaacagaaauauaacaguuaaaaagcagcauugcuggccucguauucaaauuugaugcauaugaacacacagacguagcuauuaugguggaguguacacucacuucaagucuuucccuuccgcuacuauuguucuugacauuauacgcaauagaauuuuccuaauuuggaggagauuuuauguaaaucagaacuaaaauauaaaaaagaaaagugccaggcaaauuuucauagcgccacauaagagaauaccauagaaagaagagacgaacaggaaaaagagaugauuccauucccaaacugcacacauacuccuuucccagacgcucuggccagccugcuguggguggcgacucucccccaccccaccccgaaaucccccucucugcaccaucuaggauggagaagagcagccugccuccagcucugccugcagugggccccucacucucucuuggccgccugggaaaccggccuccuccucucaguucugggcuccuucacuucuuucuucaacaguacauacccauuacacuucucgggguaaacagaacugucacuucucuugugccccacccccagaagcaggaggggacacuacauucuaccguaggagugugaugaugucauaacauucuacuaagggaaauccgaggaaauccgauccugacacacguccauggcaagcgacuauguaggugacccccuuaagccaaggucugaucugguuugaaacuggagguaguaacaucacugaacaaguaaccaagaagucauuuuuaaacaucaaauugaugcuuuguggacaggcaguggccuaaagaagaaaaaaaaggugggacccagacuaucccacaaauaggcauguccaguuuccugggccuccguguccugauauggaagguaggaacaaauaccaccuguucugccaacaguauagauuggugauaguaaagugaaacagaguuacucuuaugcuuuguagaaagucuucccagccuguggaauaauccccuacucacauagugccaggguuugccucucuaaagauacuuugucaaaugaccaagaaauuuugcagacaagugguagaccagguucuuuuucuacauuuccaaauuaucuccaaaugccuuucugauuacuccugggcauuaaaucaacaaaucacuaagagcucauuucaaagucuuccauaaaucauaaauuauuaggaacuugcuuuuuacaaaaggccugcacaaucaaaucaauccucccauaaaugccacuucaccuuuaaaacucaguucauacuuuacaaggugcucucacauuuguuucauuuaauguaacaaugcucugaacgaauaaaauagguauuaucagacaucucauuuuaccaaagaagaauggaaauaacggagcuggaucuacaacuccagccucuuuguuguuguuguguuuugaguagauaugggguuucaccauguuggcaaggcuggucucaaacuccgggcaucaagcgaucuguccaccucagccucccaaagugcuggaauuacuggcuugagccacuaugcccggcccuagaacuccagccucuuugagagccuaaccacagaacacccagcgggaucugacuggcuauuuuucccagccugagauguagaagacaaaguuaauucacacguaccauggaugccucaggguaguagggcuuaauucucuuguggaagcacugcugaaaagauuccaagauaaggcagguaaaaaaaugaccuuucccccccuauacuggguagugcugacaaagugugacucacaggugggaagacaauuccacccagccagccugucuuccaucuccaucuuggugccuagguaccagccgggccuccccuaagguucuagccucucccugccaguguuccuccucccacccuugaagagaagccugcaaaggccauuugcuguuuuucagcucauucacuggccagcaugcugcagaacagaugcuuuuuuuuuuuuuuuuuuuuuuuuaaaucacaacagcaaacacuccguguauaaacgaacacauuuaggaauaaaaguggguuggaggcgagagcacagcugaauaucugacaauauguucuaagauucaggccugagaaaaagugaggcugacuuuaaaggaauccuguuucaaucaagaguuucaauguaaaaaaaaaaaaaaggaugauuuuaagucagggacuauucauucugccucuucuccucacugacggaucauuuuuagagcacgagggucaaaaaggcugcuaaaaguccuuggcauguguaaaauuuaaaagcuuauuuauaagaauggacucaauucacucggaguuacuucauauuauucuuacuaugcuugagauauguauguauuuuuuuacauaaaagaaacaacauucuaggcagcuagagcagugucaaaggguaguccuggggcaccuacaugagaaccaccuggaugaucauuaaaagugcagauuccuccucaauuuccauuaagggaaagguuuugcuuuauuuuucuuugcagguagccaaagcuguacucagauauugcuaauaaggaagaaaaacuggucuccuguuaaccugaggacacuagggccagaggucaggaagagggaucaccuuccccaucaacacaacaucuuuuuagaagugcugccucuccuucuguaauugggaagcaccuauuacuauuccuuaaagcccaaagagggguuaguaggaugauggguauaggagacguugggguuuaaaaaaaacaaagugcagauuccuggacuucauccccagccaaccaagucagaagcaaugggcaugagaacugaggaucugcauuucaaccaggucuauuuucguacacaauaaaguuugggagccacuauucuacacaauaagguauuaaauuaggaaaaucccaaguugagagacuggaguuaggacaaggaacaggacaaggaggaacagucaguggguuucaaacacagguaccacugguaaaacugcauaucugcaggugaaagaacauggccuuuuacuuauaaauacagccaaccaaaguccaaauugagggcagauguggauaggaagagaaugagcuaagucugagguggcuaucaacucagucuucaaacaagucagggagauaaacagcccuguuuugguguacaguugguuuucaguauauuaauagauuuuucauuaaagccuacuucaagaaaagucacuucuggaauuuuacaacucaaaagugacuuaccuguaaagaguuuaaaaauuauuuuaaauacauagccuuguuaaaccaaaauuguagauaaaaacggaacagugaaugaaucaacacauuccauauggcgugaggcaaugugaaguucauagacacuggguuaaguguugauuaggcaauguguauacugcuuuuggcaauguacuguuuuuugcaaguuacuuuccucaguaagauacauuuuaacaauauuucuuaaacucuugauuagaagaaaaauauuccaaaaguagcuaucaaugcaaacgagcguuuauuucaaauaguuuuccaaucuuuuaaaucauuucaucaaacuuucccuguggugacuaccagaagauugguggucuagccaucuuggguucuuaugcaagcucuuugcuuuccagcuucccuugggaaguuacuuaaccucugagccacaauuuauuuuuuauaaauacaaugcagagaaguagacugagagcugaacauuguuuguuagggaugaguaggcaccaaacacacgauguuguuauaccuagcucauaauuuucaugcacaaaaaucaacuggucuuuuuacacuauuauaggaagggcaagcauuuuuagugaauuaaggauuaaaaucuuguuucacaaaauagaaauaaucaggacuaauguauaaaaagaugagaguuagcuguuaauugugauggcucaaaaauaauuuugaaauacaaaauaaucuucauuaauuuagaucaagcuuguccaacucacagccugcacguggcccaggacagcuuugaaugcggcccaacacaaauuuguaaacuuucuuagaacauuaugagaugugugaauuuuuuucuuuucgucaucagcuauuugcuaguguuagugcauuuuauguguggcacuagacaauucuucuuccaacguggcccggggaagccaaaagauuggacaccccugauuuagaugaaaagucugauuccaaggauuaacauuaaugaaaagcaaaaagaacucuaaagaucauaaucauggcccucuauugcaccagcuguuauucaacaugacucuggaaagaaucuuauccuagaggcaaaaugucugcugcagauguagaccauuuaacuguaaucuauuuccaaggcugacacuuucaaaaugaucugauuaacugggauugucggacauaauauaaaauguauccaagagaguuacagcucuccuuuaugacuaugcauuccuaaaggacaauuaucuuuucuuuucaagauguggauuucauuuuuuaauuauucugacucugcuuuaaacuuuuauuuuagguucaggggcacaugugcagguuuguuauuugggucaacuugaaucacaggggcuuguuguacagaauauuucaucaccccgguacuaagcccaguacccgauaguuauuuuuucugcuccucucccuccucccgcccuccacccucaggcaggccccagugucugcuguuccccucuuuguguccauauguguuugucauagaaauguuaaacgguuuauagaaaaacauuugugcauaaaaaacacugaguauuagcauauuuuaagaagaaaacuaccuuucccuagcuaccacuguugguaauaaaaucauucauugauugaagucuaagcaccugcuaagugccaagcacaaggugggagaacuacaaaaauuaaggagcuauuggccuugcccuugaagaguuccuaauucuagauggcaagaagaggucuauaaacaaaucucuguaagaacaaaaucuuaaauguguacagggugcuuugaaaagcacacuagaaggcacaguuaacuuacuugaaagauuugggugaaauucaauugaagauauuuuagcuaagacuuaaaaacugaguaaaagagaaggagcaugagggguccgcgacgggaggggaguggaaagaggagagugcacuccaggcagagaggauaccgugcaaaagauguggacaagaggugcaaaugaacccauggccggggccugggaggggaaaggaggucugaacaaaggggaaagagugccuagacgugaauuuggacuggaagauuucaaucagucaaaucauaaauggugugcuuaguaugucuggauuuuuucccccaaggccaaaauagagucuuuuguguuuguuaaaaauguccaguacaggccaggagugguggcucaagccuauaaucccaacacuuugggaggccgcagcagguggaucaccugaggucaggaguucgagaccagccuggccaacauggugaaaccucgucucuacuaaaauacaaaaauuagccggccgugguggugcgcaccuguauucccagcuacucgggacgcugaggcaggacagucacaugaauccaggagguggagguugcagugacccaagaucaugccacugcacuccagcaugggugacaggguagaaaacuccuucuaaaaaacaaaaaaaacaaaauguccaguagagacacaugucagccugacucuaaguacagauccuggccgcaaguggaguugggggcgcaggccuggaggcaaggugacccauuggguagcuguugcaguaucuuccaggugagaaauugugggacuuaaaacagcagcagccagaaugcugagcagggauggauccaaguggcauuuaggacacagacugacaugcacguggaggaugggggaacaggaguaugauuucaguuguuagcuugggugguaagugaaucauaucgacccugccaaagcugaggaacaggggugaaugaggagacgcugcauggcgcucaggaaggaaggggcuggaccaucaggaaggucugauuauacuggacuggcucaccugggggcagccccucacugggaagcaucugcagcuugggaaggagagaacuagaaaaauaaaucugugucacuguuguauagguaguagcggaaaccaugggaauggaugagaaaacagcuggcaaugaaacccuugcuauauacuaugacacuauuuaagggguaagugaacguaugggacagccacuugacagacuuucccccagcccauuaaaggugaucauaaugaacacuaugaggcaauguggaaaagugcuugaccuauccagugaaaaagaucacagcagacaucugaccaggugccauggcucacaucuguaaucccagcacuuugggaggccgagacgggcggaucacuugaggcaaguguuagagaccagccugaccaauauggugaaucccugucucuacuaaaaauacaaaaauuagcccagcauggugguaugcaccuauaaucccagcuauucgggaggcugaggcaggagaacugcuugaacccggaaggcagaggucacagugagccgagauagugccagugcacuccagccuggcaacagagcaagacccugucuuuaaaaaaaaaagauuggagcagacacuuaacauacacaaaucucaaaaguauuaugaaacaagccagagacaaaaaacagcauacuauaucuuuccauuuaaaugagaaucuaguucagacaaaaccuuugauaauaaagguuaaaucaguguuugcuucuagggggagggguguuccacugugaaauggcaugagggaauuuacuggauugacagaaauagucuaugcuugauaaggauguagguuuuaggaguauaugucugucaaacugauggaauaauuagcauuccgcuguaugaaaauuacaccuuaauuuaaaaaaucguaguaugaaguuguauauauucauauaaacuaagaaaagggaauaugcaaauaaaguuaugucagggcaguggagcugccggcuguuuucuuuucacuuaaaaaucuuaauuuucauacauuguucuaaaaaaaaaaaaaacuuuaaaacuuaaaauacccaaaaauauuuaucgaguacccaagaaaacagaaagcauauuauauuauuuuuccauaggaaacagaaaagaaucccuacaauuauggacuuuauaccugaagguaacaagaaaacacgagacaguaaagacaucaacguagaguaucaaaaaaucacuggaccaaagggacacuuuuaagaguuucugcagaagcaaagaaccagugcuuccaugaagggaguguggcucagacaguggaaacacacaggcugcuuuggacacugccacagugagacugagggaacaacgggaaagucaguggaugcugggacagcuggaggcuguuagaugcggaagguggaaagcacagacucuaccuggguuucagugcuccugaguuuaugaacuguccuuuuucuuugcaguucuuaguaguuuggguaccuugucucaacuuucauugagaaggugaagaaaaauuacccaaugggagagugacaccaacucccaucgccccacccccauuauuuuggagggaagaagugggugcuuugaugacggcgauaguggcagcucucuuuucuugaguugcugugaugggccaggcacuacaccacugcuuuauaugcauuacuauuuuauucaagcuccacaauaacgcagcaaaauacauacugauuucauaucaccagcgaaaaaaccauacucaaagaaguuagguaacauccaacuaggaguggauggacaaaaaccuaggcuuugacuccacacaccacacucuacuggaucaggagaauacucugaugaggucucauuuccacuugaguuugaagagccugucguuugggauuucuaggaauauuuagucuaaugauuauuccuuucuguagcauagaugaugcccucacaaaacagccagugugguuaauuacuacacagcugucaagcugcauacauccuaauaccuauuauuuaauagcaguuaacacuuggugcuagaugcuuuacaaugcauuaccucauguaauccucacacccacccuuggggcagacaauuagcaucgccauuuuuaccgaggaugaaauugggacagaagagauacaaagugacuuguccuaagucacucaguuaccacaaauguggccccggacagugugacaacaucagccuaaccacuuuacugccucaaaauuuaaaacuggguucccaacuuugcuaugucaaugucaaaguuaguuucaugcugaaacuaacaaucccacuggcagccuugagaguguucuuccuggaccgcuucaucacaaguguuuacagguuucgcuucccuccacuuacagaaccaaaacccuucuccaaacggagaacgguuaccaucagauguaugccugcugcaacagcagcaaugacacauucccuaagaagccagcacugggugacuggggaucuggauaggccacccacuguaccaacacucgggaggcaggagaagcagugcaccaggacagcuuccuuaucaaggauaggaaggugacagugggcacagacuguuacagcuauuuccugucaggcuaccugacucacuggaggugcugaaucccugggccccaacugcgguugcuuaauugugcuguccacuaaaauguaaaaagagcauccuucauugaagcagagcgaaugggcacaguguuccauucucauugcugccuugucuucggagagaggcugaaaugugaaccucuagguaggcucaccuccacuuccacuggguuauaaugaacucugaaacacacacaaaaaggccucuuuccugaucuucuaacucuguuaauuauguuauuuaaggcauggacaaaagcaaguuggguuggucauuuagguaaucauaagggcugcugucaaguuaaguaacauggcagaaagccugcaaagucugagagcugggcugucucucagcugggauuuccuugaacuguuucaccagaacucucaagucuuugggauucugaaguuuccaucugucuuaaaauuacuuuuccauaaagaggccuucauuuccacagccuaaaauaaagugaggacugaugucuuggcuagguauuaagaaucuggacgguuagucagggauuuggccucaccucccacuggaaggggaaaagggaagaugaaugcagagaagucuuuuacagagucuugcucuguuggccagacuggagggcagcagcacaaugacagcucacugcagucucgaacuccugggcucaagcaaucuucccaccucacacuccagaguagcugggacaacaggcacacaccaccaugcuuggcugauuuuuaaauuauuuuuuguagagucagggucuugcuauauugcucaagcuggucucaaacugcuggccucaagugauccucccaccucagccucccaaagcgcugggauuacaggugugagcuaccacacccagcccagacaaagucuugaccccacguucacugccguuugauuucugcuguggugaaggugggagaauuaagaguguucaaauccagcaaaucagguuggcaguguggucuuguccaaaagaaaaaagggcaguuucuccuagaguugggugaacacaauuugcuucucuggauguuaccuugcauuauucauacaacauaccugggcauauuuugguggagacuguaacacacacagaaaacugcaaagggcaaggaaauaagcccuagaauggucagcuccagaucuggcugaagcugaagcaggaaguugauucucuagguugaggagcccagggcagagagaagaaccccaaagcggucagaucacuccaagauacgaguugacguagaaaagggagugucggcugggugcgguggcucacaccuauaaucccaguacuuugggaggccaaggucaagagauggagacccuccuggccaacauggcgaaaccccaucucuacuaaaaauacaaaaauuagcugggugugguggugugcuccuguugucccagcuacucggaaggcugaggcaggagaauugcuugaacccgggaggcggagguugcagugagucgagaucgcaccacugcacuccagucuggugacagagcaagauuccgucucaaaaaaaaaagaaaaagaaacagaaaagagaaaagcaaaacaaagcaaaggcagugucgugucuguuccaugaacccuaagggcuuccaggagagaauggaacuaaaauaacagcguagccuggaaacuggagggcugggugguggguguugagaccuggaaacugcagggcugggugguggguguugagacauguaaacugcagggcugggugguagguguugagacguggggcucccuguggagcggggagguggugaaccaucagccccccuccaaauaguaagauuagcauagaacgugccuuuuucagccaaguugccuucauggacagcauccuuucaacuucauacucacuacucacaaaccaacccuuggaaguacaacggauuuacuguuuaucaagaggggaaacuuucacuauucucauaugaaaagugcuucagaaaaaaaaaugacaacauuauuuaacaggaauucacacaauuacaaaaauaacucugucccucucuucagcaagagaaauauuuugcucaucagaaguucugcuaggcuuagucagaucagugccaggaauucugugaacugaaggucaagcugccaagauucaaaagaaaugucgauaguaaguguuugcccagauacuagacagggagugccaacagcucccagcaugcaacuccagccacaacgcagacaggacaaccacauuuuccaguguuccccuugucccauaaaauuuaacaacaacaacaaaaagcucuuaccuagcucuccccggagguuaacaaguucuugagauaggguuuuguguuguuucagugcuuccucccgcugcggaaaacacacaucaaguuacucaugcuuucaagagggucccuuucaguaagguacacauuuguuaucacuaggaaaaugagacccaguauugggaagccaagauaugaaucauuuaggcuaacaauuuguguuguuaaaagaaacacaguugucccuuagcuguuaaggaaauucguaauucaaaaaucuguauuuuugcaggucccagugaaacuuugguuugacgcagugaauggcccauuuagaaauauuuacuuugagccagugcuucacugcugauccauagaaccuuucggcuaaugcauacuguacuuaagauguaaugcguucuccuccuccaagggcaauaaacaucuaaucaguuuaagauaaauauuuaauguucuaaacauaagcacauauaugcacuuuguccuauauuugcacauaaaaaaguuucguuacaaugccaauccuucuaaaagaaagacaaaaaguuuguuagaaagcuauagcagaaagauaauccuuuaaagacaaaauuaaauuaauuuuuuucagcuacauaccauuuucuaaggauuaugauauuuuggaucagugauaauucuaaaucgauguuagagaaacaaaccaaagaaaaccggauggcuguuuuuaguaucagagaagcaaguaucaaccuugagcugaagaauaauguucaaguuaccagcaacucccggcaaucacacauacacacauacuuacacaaauacaguaauuacauacaguuccuuaaaagguagauucccuagcaccagggaguaacuaaaaaaaaaaugaagaauuucaaagcucgcugaaaaaugcccucacgaggaucacccaagacggagcucccaccacauccugaucacagcguugcagagaucaugagacccggccuuugcaggcaagaguugcuugucauucaaagcauuuucccugaauuccagacagccucugcaguaguccugacauucuuccagaaaagcacuauaaacaaauacuaauuacccuuguugcugcacauggagaauagaggcacaguuugcugcuggggcagcccauuuuccagcuucugucuccaaguccccccaccccucgcacugugcaagaagcauacagguggccgcgccacccaccagucgggucugucuacauucaaagcucuagcaggaggcgcgccauuggcccucgggcgucuuacuucauguccugcagguuaccgugugccucggauuccucacucacagaagcugauacugcagcuucugccuuuggcacaggcagccugugauuacuuaaagccacagccuuucauuuaugaaaaacgagaggcaggcauuagacugaucgauugccauuuaguuaaauaucagcugcaacggaggaaagaaaaaacugacccccucugcauggauaauggaguuauuuuuagacuugugagccuuuuucuuccccucucuaauuguggucauuauuugaucacacuuacuaauagaaaagggaaacuuguucuucgaagcccauauacuaaaugagguuaugaacuaggugaagagcaaggaaaggggcaugcugucguuuacaaauuuaaaugacauuaugaaaugagagguguuucaaaauaagucugaagugcugaucugagaguuggagaucccauauauuuuuaacuuuuacuuuguucucaccucucaguaagagcuacggaagucaagucuaaacgccagcacugaaacguggucagcagggacugggauuuaagacccacuuuucacugaguaccuuucuggcuucaaugguauucuaaaugcuugguuuuuaaaaauauggcauuaaguuguucugaaaucaccagugagucagaguuucuuaaaauaauaaguaauugguuuucuaauguagaaauuaaagccugaggaaaaucagcccgcauaauaauggaagaaaaacauaaaaauauguaucauaaauacuucucguaauaucaaauuuaagccugaauuuuguuuaguaaucuacuucaaguaaacaccaggaagcuuuaccacucaaguaacaggaaaaacaagacagcuuuacuaaaugcccacaaacaauccugaaacucauuuggugaacuugcuuaaaauucacuuuucaguaguaaccaaguuacuaacagaaggaagagauggcaagaaaauucaaucauuuuucaaauuuauggaaacuaaugggaggaugaaagaaauuaaaaauuacaguuaguauaacugcaaagaaaaauugugugaaaucauuauguucuacugcaaaaauacaccaggugauauuuuugcuuauuaagggagguuuugggaaagggaguuucaccaagcaugucgacauuuccccaaacuucaacuccacugcacuccacguuccuguccuuaaugccucagaaacuacugacaucuuccaaccucugucaggcacaguaacaguaacaggaaaaccuugaggucaucuuucacucuuugucuaaauggguugugcaaaagucaguugguucuucccuuguaaugugacaccauuccccuccuccaaaugcauagaccauuuacccuucuaaauugguugguaacuuauuacuucaaacuaauuaacuaagcauuuuucauagcagaugcugugaaaauauaaaagaaauuuaagacauggucccugccuucaagaagcauggggccuaccuagaacuagaacauccaggcucaauucuuuuggucaucuaucaaggcagaugaccucaucggaugggaagcaguaaugaaaaaaaccaagggcuuuaaauaccauccauagaugaaaugcugaccccagugcccauacuguaaaagacacauacuaaggguuaguuucugccugacucucccugguagcuuggccuuuacauguacuuacccuuuacuuguagaugauaaaaugcauuauguccuuuagauacugauuuacuguuucuuuuuacucagcugcuccuagaucaguguuucucucuuagaugauaaacucuuaaccgucuagauaacagguugauucaauucucuuuguauuguaacaugcagaauuacacacaaugugaaaaaagagaaagguggaaaucuggauauaaagaugccuuuaugcucaggcauuaaauauaugaaaugcucaagaaaaaaaaaauggauucaccauaauugaauuaggagucccugggacacaggcacuuagucucuggcuguggucccaucggugugccugcauuuuugcuagccacugaguagcaucaacagcauagagcaucuugcagagaauagccacaucagauggcucagacgugugcugcaucugaccuccuccccaucacccacacagugaauuugcucaaugcaucuauguuuuuuuguuccaagucaacuuuacugcuagugccauucaaaauucaccuuuguucaggugcuacuuuagguuaaauuccacuugcaaaaaaaaaaaaaaaagauguggaggcauuuugaagaauuagagguuuggggagggugaccucagcccuguucaaguuuaccuagaaagccacccaauagacccuuuuaggaagaagcuuaauuacuaccaucaauacuguuguucacuuuggcugucugugcagaauaccgucuaacuaagcaaggauaaaccaagaauuagaaaaaaacuaaaauaacuuuagugugucuucugcgaaacagagugugacauuaguucucagauucaugagauauaagaaugucugauauguaaugaaauaugucugccacuacagugggaaacuuauaguuacuaaguagacuugcaacaaaagcaugguaguugcaagauucucuuaaccauuuucacccauaaucgaaggcucuaaagccauuuagaaaagguuagcaauaacaaaaaauauauauacacacacacacacaaauaccuauauauuauacauauauaaaaauacauagacauacaauguauagguauaucauguauauaaaaaacauacauaauguauauguauacaauguguaucuguaucuauuuuauauacauaugcaugugugcgcgcgcguguguguguguguguguguguauaaacacaguauauauacuucuguaaugggaaugggaacuaaaagguuaagggaguuuuuaaaauuguuuaacuuuacccaugauuuuuuuucuccaacuauuuuuauuuuauuuauuuauuuauuuauuuauuuauuuuuugagacagggucucacugucacccaggcuggagugcgguggugcgaucuuggcucacugcaaccuccaccuauuggguucaagcgauucguaugccucagucucuugaguagcugggacuacaggcacaugccaccaugccuggcuaauuuuuguauuuuuugguagagacaggguuucgccauguuggccagacuggucucaaacucuggaccucaagcgauccacccgccucagccucccaaagugcugggauuacaggugugagccaccaugccuagccuccaacuguuuuauaauagugcucaguauacauuacacaaucaguaaauauuugcugauuauaaaauaaagagagcaaagaacauuuacauaagacuuuaugcucauccuacaucuggaauuccauccucuccguucauauguucacucacauauauacuguguugacuauuaaagcugcuggggugguuucauaagaaagaacuagaugcagauccugccuucaguaaauuuccugucuuaaaaagcaaaaacaagcauuaaaccgguaucucuaauauaacacagacaaugaaagagaagcauauaugcuccuggaauccagacgggaacagaacguagaucuagaaggccaggaaaucauuccugaguggguucuggacugggagugguggaucaugccuguaaucccagcacuuuggaaggccgaggcagguggaucacuugaggugaggacuuuaagaccagccuggccaacauggugaaaccucaucucuacuaaaaauacaaaaauuaucuggguaugguggugggcauccguaaucccagcuacucaggaggcugagucaggagaacugguugaacccagguggcggagguugcagugagcugagauugcgccacugcacuccagacugggugacagagcaaggccacugucgcaaaaaaaaaaaaaaaaaaaaaaaaaaaaaaaagcggguucuggagcuguauucagugcagucacaauuccuuggcugucaggaccuaaauuuaaguauaaggugaaauucacacacaguacaauugucugggaaauucacuaggagcuugccauguuuguggacaaugcaucucucuguagauccaacccagugaauuuuuuuccucuagcguuggaucaacucucucuauaacugagcaccugauaaaggccucggcuuguguuuagaggccagguugcaugagggaaaaguaucuuuaaacacuaagauagcagagaguauagaaugcucacgccacaagagguguucggggacugagcagacacaugaaggaaggguggacuccugaccuucaucucaaauugacucccgggccuucguucacuggggggaauacaagguggacuuguguucuucauuuaauuugcuuuuuuucuuuuuuuuuuaaguuggaaucucgcucuguugcccaggauggaguguaguggugcgaucuuggcucacugccaccuccaccucucaaaguaaagugauucuucuaccuuagccucccgaguagcugggacuacaggcacaugccaccacacauggcuaauuuuuguaguuuuaggggagaugggguuuuaccauauuggucaggcuggucucgaacuucugaccucaggugauccacccgccuuggccuccccaagugcugggauuacaggugugagccacagcgcccggccugcauuuuucuuccuucaguuguuuguguacugaaucuauguaaauuaaaugcaaguggugaugugaugcugcuguaaaaccgaccugaacauguagguauugugggcaaggacagcaacccaguaaugauacgugaacaauggaugacguacaggaaguuuacaggacauuuuuaguugauagcuuccuagaccuagguuuacguccugguucuccucuugcuagcugucugauagcaggcaaauuaccuaacucuaugccucaauuuucauauuuguaaauuccaacucgugucuuuggugaggauuuaaauaagguaaguaagaauaucuggcacuuaguaaauauuaggcuggugcaaaaguaacuguagcuuuuggcaugauggcaaaaccgcaauuacuuuugcucaaaccuaguauucaauaaaucccucuugcuucuccuccaucucuuuauguacggcuacagcaucugggcaugauaauaacauuaaaaggggcaguuguugccaaaugauaaagagccuuauaguaccaguugaaaaccagacuccccaaaacaaaauaacaugaguuacguaauuauaaauuuccuaguagccacgcugagaaaaguugaaaaagaugaagcuaauuuuaauaacguauuuuauuuaacccaaauauauauauaaaauaauauuucaauauauucaauauaaaaguuguuaaugagauauuuuacauccuuuguuuucauucuaaguuuuuggaauccaaguguauuguacacuuaccacacaucucaauucaacggauuuacauuucgaaugcucagucucauauggcuaguggcuaccacacuggacacaucagcuguagauaagggagaaccacuggaagauuuaaucagcagcgugggaugcuuugguaagaggacgcugucagcagugcuugggauggauuauaggugagaaacaguacaagccuaaugauugguuaaaaaggugcuaucacagguugggcgcaguggcucacgccuguaauugcagcacuuugggaggccgaggugagcggaucaccugaggucaggaguucaagaccagccuggcccacauggugaaacccugucucuacuagaaaauuacaaaaacuagucgggcaugguggcgggugccuguaaucccagcuauucgggaggcugaggaaggagaaucacuugaacccgggagguggagguugcagugagcccagaucacgccauugcauaccagucugagugacagagcaagacuccaucccaaaaaaaaaaaaaaaaaaaaaaguugcuaucaugaucuaguggaagcuauccagggucugagcaaggauggcaugaauggggacagcaaagacauaggaaggggaaaagcacugugaaaugagaguucacaggacuugacugacgucaugaggaggaugaaaggagagaaaacaguugaggaugggggcuauuaggcuagauauaauaaaauaaaauaauugguuuauuucuaaacauaaaaacuaauuguuccccacauuugauaguauacaguuucuaguuagcuuacuugguuauauaaacacacucuugauuccuuucuuacaaaugaaagagaaacaaaaauaccauauacuauuaccguuacuaaaacccuaaguagucuccaacuuccccucaaaaaaaacaaaaacaaaaacaaaaacaaaaaaaucuggagaaagcuguaaaauacucaucaagaaaucauuaaggcugggcgcaguggcgcaugccuguaaucccaggacuuugggaggccgaggcagacagaucacagggucaggagaucgagaccauccugccuaacacagugaaaccccgucucuacuaaaaauacaaaaaacuagccgggcgugguggcgggugccugcagucccagcuacucgggaggcugaggcaggagaauggcaugaacccgggagauagagcuuguagugagcugagauggcgccacugcacuccagccugggcgacagagugagagucugucucaaaaaaaaagagaauucauugaaacugucuacuagucugguaguuucuccaaggcacagaccaagucucauccacuucucucucuccccacucccuaaaaaggcagccauauuacaggggccucuguaugaaaccaggacagguuuguugaucugaacaaaacuacagaacaaccaaacugaacaguuuucuuuuugcuuuuaauuuuuauuuuuucccuauguugcucaggcuggucuugaacuccugaccacaagcgauccucccuccucgucuucccaaaaugcugggauuccaggcaugagccacaguacugagccagucuuuuuuuuuccccuuugcauuaucauguauagccaucuuuaaaacugugauuuaaaaaaugucugaagagcucaaguuguauucuuaucaguugcccccugagauaauuacagcuuuuauugcuaugucaguaacauguugauauaaacuugguuuucucaaugaauuuuagccaguuccugaaauaacaucccugaagaauauuagggaaaaguaacaacacggcaaaucugcuuugcuuuuguugcaccacagagauuguuuuaggaauaaacagaacuuucagaaagaauccccagauaugauucagggaguuaacucaaaagugcucuuuaauccauaaauauaacuaacgucauuuuucaaagcauuaaacuaagugugauaugaaaagcuacacacagacaaacacacaaauuaagugaaaaaaaugcuaaugcuaguuuaggucuagaggcauacaccggcguaagaggcaauuauguuuuuugcuguugccauucuaaccaacagacucuaggggaaaaaaaggaagugagaaaauguuuccaucccaaauugcuagagaccgacucaaguaucuggugaagugacaaaaauguaaugggaugaaugacaccugaucuuucccaucauuuaccuagauauucccaaggccagcgugugagcaaguccuccccgugcucccccgaccucaaguagaaaggcucuuucuaggaugcaccuccuuaccucagacagcaggugcugaaucacaacugucaaugccucaaacuugguauuaccacaggcaagaagcugcuugagcugcaggauaaauccacuuugguuuucacauuuuguuuuauauugcgucaauucaaguguuuucucagggggcagcgcaucgggagcugucuguggcuggauacauaagcuucgaggauucuuuugccugcucuuuucaacugcaaaacgaauuaacauagguacaaagauaggugagguuaauuuuuaaaaucaccaccacaaggauucaaaaacaaccagauaagccacagaaauccauuuaaguuauguugcuguaaggaaugcauauggaugagaacuggaaugaaucggagaucuagacgguuggaauucaugaacagggaccguggcuucauuuaugacuuuaaaagauuuauggggaacagagaauuaggaacaugacacaaauggauuuggcaacccagaaacacaaaaacugggugcaaaauguuguucuccucguuucucauuuuccaguuaaauugguagagaaaccuugacugaagagaagccugacuuuucugaucucauaugcugaaaggaacacacaaaucacuggacuuuaaauuaaaugccuuucucuccucccauacauuuucuacaaaucuuuuaccuuuucccugaugauggccuagccauuacacagauuuauaccgcagaugagucauuuccuaaucucuaauaaaucauaacauacaucgaaaauauacucagauuuugccucuuuaaguucacuguuaggaguacuauacuguugacuauacuauuccauuuucuaucgaacacaagcuuuguuggucuuuuuucccaaguaguaauaacggcuuacacaguuuuuuuuuaaagcacaugcuaacacuccaaauccacccaaaaugccacgcuaagugauuauucccuuccugugcaauggugcccuggguauuacucuguuuuaaauaaaaaacuguucagucuuggaaccauuccaaaugugucauuuugaauaucaaacagaauuggaaaaacaggacaucaauugcuuagguucuugaaauaaacaagccaaguaauccaaacaaauguaaaucuggaaaaaagacacaagaaacuaaaaaaaaaaaaaaguuuccuuauucuaacagucuuucauuacagcauccacguucugugguagcaaaucugaaacaacuuuuaaagaaauuuaguaauuacugucucuaauuuuucaggaaaaggcaagcuacuacagugauugcuuaaagaaacaucaguacucacuuucuaagaacaaauggcuaaauauauugaauaaacuaaguuaaaaacagggaaaaaaaggcucuuauuuucuauggcugcauuacaugguuaaauaagucauauuuguauuaauacuugauaauucucaguucuaaaaucacuaaaauauccauugucccacugugucucuguaauacuugaugagaggaaguauuuauccauuacucuuuauuauuagcaauuauuaguaguagcuuaugaauaauugucacuugcauagauguagaaaauagccaaguuaauaucguaauauuacagcccugaaggaagaacaaauuauuaguuacauacuaaugaaaaauaaucuaaauauuugaccaugagauuagcauucuuucaugucauuuccuaaauguuuuuagaaauugucacauaacacauaacaauuccacaguguuucgcucaucacagugugcucucacuuucccuuucuuuucauccucccaauaaccccagauagggaagagaaggcucacaggugugaaugucuucccuggauguagacaacuucuaugggaauccagauucaaagucagaacccaggccucugaugcuaagccucuucuguucccacacauuuuggaaagcggauuagguggugauguaauauaugacauacauaaaaauaaauauuuaugcaacaaauguaauaauaucuugcuauaauacauauaagcccauuaucugauaacucauuuuaacaaaccuacauauaaacaucuauguguuauauaacuuuauaaacaaaaauguucaaauucuuucacuaucuagaauuuacuguaacaaauauagacacaguucauucuccugauaucauuuguauauguccuaccgaaacuuacuuaaaaauucauuuauugauaacuccuuuaucauuuccugaguccugaguaacauuugccucucuuucuagaauuucuaugcuaaucaacgcuauuuuuaacacaauuucagagcuuuaaaacuguugguuuauaauuauuuacaaaaucugagaggugagucuuuuauauuaauauuuuggagaaaauauucuucaagauucuugcuuuuugcuuauaaauccguaacaaaaauaucacagaauacauguaauuguacuaacaauguuuacuuuugaagggaagguaauaggaaucagacagcuaaaaaguauccugaagcauuuuuuauacuuuuuaaccaugggguaaauauauuaccuauucaaaaguuaaauauaagaaguaaauaaaaucacuuuuaacagacaguuaaagugaaauucgaggacauacauuuuuuauauaauacuuagcuaugaaggaaauagucuaugcagaauuuuuccuuggggaaacuacacaggaaucuaaacauuacgcaggguuuguaagugauuacucaggauagcuuuaugauuaaggaggaaagaacacauugauguauucgucuaagaguacgugucuucaaauuuuaaaaugagagcaaaugagccaacagacugcccucuccguggcgcuggaaacucgugcugugcagucaccaucuuccgcuccauauacugugcucccuaaggaugaagugugaccgcauggcagccgaugacccaguuuccacaugcuucccacucucagcacuccuggcucagcugaagaucagagaugaugcaaaaaucuccaaugacgcucaaaaccccaaggcucaucaauacguacuucacaguacugaaaagccagggguucccuuaaauccugcaggauucauuacuaacgugaaauuagcauauuaucagccaaacuuugcccuuacccuugcuuauuagcauguuacuguuuugauaacaaagguuuuauacagaaguauaaauuauuuuguuuacuguaccuauuaacagaacauguucugauuuuaaagggccaauuuaaucagaaaccuuaaaauuaaacgucaacuucuauaucgauucagauuuaucucaacaagauaauuaccaccaucagcugugauccagccuuacugggacucauucuaaugaaauggcagccuccaucaggaaaacgaaggccagaaccaaagacauuugcucauuuggaaagcagcuggaugacccuguuggcuaucuuuguucuuucuauucagaaaccucaauuuaauaagauuuaaaacuagugcaaugaagucauguaucaucuucuuaaagaaaguaguugguuaaugaggaagaugcccauuucucaggcucaaaucacuuaggcaaauagaccuccaaaucccaagaccaaaaacaauuuugagagaaaaaccuaaccauuaagacauggacuaaccguaaccacauacuagcagcugaggacacauucauucuaggcugaagaagccacacauuuccucaaucugcuggcuuuuccaauuauuaaaaucaaguuagagaccagaccuacugagggaguuugccuuggguuccgugaaacacaaacuaaacacagaauuuggaaacgaacguuguccacuuuuguguauacucacugaccuacucacucacucaugaaauauauuuauuaaaaucuaccaugagggcacugcuguggugggugugcaccugcccuggugcuuugcggggacaggagaaguaucacauaagagggugguauugcucagagaggcacaaagacaccaaagaucucugcugacucauguuucccuagugcucagcucuucaacuccaaaucucaaccuaucuguaaaaaggugacagucacugacuggaugguaaguccuuucuacaacauauugcauuaaaaaccgauguuuguggguugacaaaacauagguuaugaacucagaagcuagugagaggucucucucugcuagcggcauggacagacagaaaauucccuuuuuucugccuuaaucuaaucguacacaucuaaaagcccucacagggacacugacacagaaguucuuucagucaguuuccccagcaucugguggcaggugcuuauccugccuaugcaaucuuacauacaguuuuuuaaaguuaccauucaugucaauuauuaguuuauguuuguauaaaguuuucuaguguucauuagcuguuuacucuaaaagaguuaacaguaauaauuuaggagacauauauuuuucuauuuacauauaauauuuuucuauuucuagguagacauggcauuuacugaaaauggaaaauuuuaagcucagcaaagcacaguguuuagacauuuagaauuacccaagccaggccgggugcgguggcucacaccuguaaucccaacauuuugggaggccaaggcgggcagaucacaaagucacgugauugagaccauucuggcuaacacagugaaaccccaucucgacuaaaaauacaaaaaguuagcugggugugguggcaccugccuguacucccagcuacucgggaggcugaggcaggagaaucacuugaauccgggagguggaaguuccagugagccgagaucacgccacugcacuccagccugggugacagagcaagacuccguucucaaaaacaaacaaacaaacaaacaaaaaaccccaagccaagcccaauuauuuguagggggagggaggaggauuuaggaugccucaccauuuaaacuuuucauuacuauauugguagaauucguugcaauagcucauauuauaucaaaaaggguucuacuucuuuucuucacauuaaaagcagauuagagaauagaaagcauauucgagaauagaaagcauauucauauaaaaaauuccuguuuggguuaauuacgcuuauaaaauuuuuccugaagcaacaguccaaacuugcccuaaacuauuuuccauauagcuggcaggaaaaaaccaaauuucucauacucuuauguaccuaaaauggacuccuaacucaaagaagaguuaauauaaauucaccacauucagaaguacuuuuaagaaggcauugccucucuccuauagcaaccaaaaaagcauggcacuggucuaaaaauagacacauagaucaguggaagagaacagagaacccagaaauaaagccacaugcuuacagcuaauugaucuuugacaaagucagcaaaaauacauacaauggggaaaggacacccuauucaauaaauggugcugggaaaauuggaacagagaaacuggagaccuaucucuuaucauaugcaaaaauuaagacagauuuaagacuuaaacguaagaccugaaaaaauaaaaauuccuggguggggggagggaacuagaaaaaacucuucacaacauuggccgacgcaaggaauucaugacuaagaucucaaaagcaaaugcagcaaaaacaaaaauagacaaaugggacuuaaacuaaaaagguucugcacaguaaaagaaacagucaacagaggaaacagacaaccuauagaaugggagaaaauauuugcaaacuaugcauuugacaaagaucuaauauucagaauuuacaaggaacgcuagcaacuagcaagaaaaaauacaaccccaauaaaaaaugggcaaaggacaugaacagauguuucucaaaagaagacacagaagcagccaacauauggaaaaaguagaacauacgaaaaaaugcucaacaucacuaaucaucagagaaaugcaaaugaaaaccacgaugagauaccauuuccuaucagccagaacggcuauuaccaaaaagucaaaaaaccacagauguuggcaaagauguggagagaaggcaaugcuuauacacuguuggugggacugugaauuaguacaaucucuauggaaaacaguauggagauuccucaaagaacuaaaaauagaacuaccauucacccagcaaucccacugcuggguaucuucccaaaggaaaagaaaaacacagacuaucuuauaacagaaaugaaaauuaaaauagccaauuaaaacauuaaacauuagaaauauuuacaauacaaacaauaaauaaaaagagaacaucauucucaaaauacuaaacugucgacaagcaauuuggaagaaacgugccuaggacucaggucaccagggagaaaaaaggcaaaucucucaccccaaaagaaagcucuauuacucuuaauuuuccacagagccacauaauugcugauguuuauaaaaaggacccucguguacuaaaaugacccaaaguauugccuaagauaaauacagaaauaugauauucaauauuagauaccucuaaaaucacaccuguuguguuucuaagaaaauaauaugcauauacuauuaauaaaauauuauucuuagcucugaaagaggcuuuaaagcucauaaaaagcaucauuacauuaauuuauaggguaauuaucuauuaauuaaccagaauaaauuguucuaacaaaacaaguauuuacuuauauacagcuugccauauuccuccagugucucuugaugaaaaacacugcuauccuucccauucugaaugcaacucuaaaccguaauuuauuacuuacuuuccauuuuuguguaaaaguagauacuacauuaaaacauaauuuaguguaguaaaacucuaguuaucugaaacuugucaaauuaggacauacugucccuuucaacaucucacuuuuaaaaacuuaucaaaaucuuaccuauugugagcaaaacuugccauucaacacuuuauugucuucuucaauugaaagcuguaacuacaaaagggcagauauucaugucacggcaaagcuacagcucuaaaaccgccacagcuaccgaagcuuggaaucaauccacgacaaaacguuuucagcaucaugccauucaucacaccaguucuuagcaaaugcuugucuauguggcaagaggccagcaaaaucuuucaugacugcuuucaaggaggcugaaaggaagaaucuggauucacaguaagauaacuaaggggcagugaaagacuacaucucucguucuucuucaccuugguccuuuugauuucuucuacauucuacaaaucccugaauuuuaccuuuucacacgcaaaugcuaauauauguguuuuuuuuuaauggaagcuuucuaauauggcuucauugacgucuacauuuuguaguacgaaaaacacaagagaaauugaaguuuacuuacugucaccuuaacaguacaugaauaaaugcccuccuaauccauaacacauccauaaaugcgcuaauaacauauuaagcauacaaaagccacauuuaaaguugaacacauucuucccaauguauuuuauaacugaaaauucauucaagagaucaaaaaucaaauguuaagacuuacguccaaacgacaaaauaacuugaaaguuuaauggaaccauuacacacagguaaucaaugccccuccaaaacgcauagaauagagaaaaaauagcaaggccuguugcaagauccaacuuguuaaauaauacacuccccucauuuauaaucggccaacauccgcuugagaaauaccuguucugccuucucuguggcagauauuccaauagagcucuuauaacauuuuauaccugucugugggacagagacuagagaagucacacgcucuauuucccagccucccuuccaggucgagucaugugacuaagacccggccaaugagacggaagcuuaagcgaccuggcaccaccccuuccucauuucuuuuucuuccuuccuggagcagcuacugugagaucaugaggcaacaaucaugaggacacggcuaagaagacagcagagaugaggauuccugacacggcagagccaccgaacaaccucaaagcugcuuuucuucaggugagacaaguugcuucuuagugaagcuguuaauuccaucuaaaaagagucaaaagugaauaccaaaugcgagaacauaauuugaugaauuucauccuaauuaaacaaacgcauucacauucugccugccuguuacugaacacuucuuuaaaacgguucucuucacgaacacaaagaagggaaacaacagaugggggucuaauugagggugcaggguaggaggagggagaggagcagaaaacaauaacuugggugcugggcuuaauacuugggugaugaaaucaucuguacaauaaacuauuuauuguacaagaaucuguacaauaaacucugugacaugaguuuaccuauauaacaaaccuuuacauguaccccugaaccuaaaaguucaaaauaaaauaaaauggcaaaaguaaauggaaauauuuuguucugauacuaccucugccaucccucgauacguacguacacauguuccucccuugcgcugcaguaaucacuuuuaaugucacuagcucagcagaaagaauucugucuuuagcguacugaauugccuucacuggagucaagaaggaaauuaaccugugagguucaaauggcacucuucauagcaauuaauacaagaauuuccagcuucauagaaaaacugaaugcuaaguggcagggaauauuucuuagcaaagucuuuucccuccacuaacucauuauaaaaauagaacuaauauguugagguagaauuccgaaauagaccgaguuuaauacuuugguaaaaagacuauugcugacccuucuccaugucagugacgucaucacuggacuucuuagauuuucaucugugccuaauguccugcaacaucacgcacaguuccugacaaauucacucuuuuccuccucuccccuguuuaaagaggaaagauaaccucgauccaacaacacgcuuugccagugauggauaccacccaguaauaauauaucagagugcccagugcccucugcgugggaucaaugagaaagcuuauucuggccggaucucuacaaugaccagcccccgucccaccacauucuaugcucagaaauacuacaacuccuuuguuuccuugaaggagcccuuccucaagccccucaagguuuuuacaugcuguuuucucugucggaaacacuuuguuucuuaguaaauucuccauuuccugaggacccaacuuaaaaggcacuucuacuggaggaccuggauuaaagguaccuccaccugcugagagcugcuugggcacaaguccacacccugcauuauuaacuggugcucugucuccuucuguuaaacagugggcugugugaaggcaggguccaugugggacuuagucccagucauacuuucagcaccuaccauuaugccugguacacaguacucaucuaacggguacuucuuuaugaaacgaaugaauuaaucuguaaugugaaagacagucuagaagcaagggaaaggcuggaggcacagaccaaauacuaagcucuucagaaagcccagucaacaucuuaggcuggauuauacaaaacuguuccuauuuggcuacuuuugacuuauuauacaaaaguguucauauuuggccacuuuuuaccuauuaauuuuuugugugugguuuuuuaaauagagacagggucucauuaacucuccagggcuggucucaaacuccuagccuuaagugauucucuucccuuggccucccaaaguacugggauuauaggugugagccaguggcaccagccaggaagagcaguuucaaugcuucaacaugauaaugccuggacuaggguaauggcaggugguaaaaacaaaucaagauuucaaaugauggagucuuagaguuuucaaccaauugauuguggauaaaucaggacaaguaaugauucaaaggugagguuuggccagacgugguagcucaugucuguaaucccagcacuuugggaggcugaggcaggcgaauugccugaggucaggaguuccagaccaguauggccaacauggugaaaccccaucucuauuaaaaauacaaagaaauuagccggguaugguggugggcaccuguaaucccagcuacucgggaggcugaggcagcagaauugcuugaaccugggaggcggagguugcagugggcccagacagcaccagugcacuccagccuaggcaacagagcgagacuccaucuaaaacaaagcaacaaaaaaacaacaaaaaccaaaggugggguuugaugaccagacacauggugucaugaaaagaaacagauaauucaugaguauuaacugaauuuaggagguaaaaaaauaaggagacaaaucauuuagauaagaugaauuuccaagcagaguaauacacugaggguuuucaaaucuucagccagaaauucacagauuuggaggcuaaggggaaccuggaagucaucucuugugguucccuuauuuuguagccgugugagguuaggugcacagggcuauucacuuggucaccagcagaaucaaggcuacaauccaggccucuugggauccaggucaacaccacugcacugaggcaaccaacaccacuuccuucacuaaggauaccaacccaaguuacugcugacaguccauucagauaagagucaccaugacggcaugaauuacccacuugacggacgauuucucggacguuaaaaugacauaacauggauaagcccaucaaagacugauauugggaguaagcagaauuauauuccuuacaugauuuuaaaaagccuccaacacacaaaacgcuuccuccaucccugcuauuccuuggaucuaacaaaauuacagcaaaauuugcagcuggaaaauauguacgccaaaaauucuaaauagaagucccagguuuuaguccuaucucuggcacuuacugugugccucugggcaagcgaauucacuucucugggccucagacuuccugguauaagacagauuagaucaccucuaugugaacucuagcucaaaaaauuaugacugcaaauaaacagaaaauaguuuuacguaaguuuagaaaauaaaauguguccaauacaucacuaucaacuaaacccugguaauagaagccuugugucguuugcuuacgcugucuuggaaagcuaucugcuucacaacaacacuacagacaacuuagaaugucuacuacuagagcacugguuaaguaaaucaugacuuacccaauaauggaauguuacagaacuauuuuuuuuaaugagguagauaaacaugugaucacaugcaaaucuaaaacacauuaacuuuaaaaagguauagaauauauaguacgcuuuuauuucuguauaacaaaaaagaauaaaaaagaccugcauagauuuacaugugacuggaaacgugcaagaacacuaugcaagcagcugagagcggcugucuccacggagagcagacagggacucuggguaagagagaggcuugccuaggacugcacaaccuuccauacuguuugauuuuuaacuuggagcguggauuacaguauuuuuaaaagaacucuuuaaaauuaaaagcuauuuggagcuacuuuagaucagacaaauuauugcaaauauagggcacccuuuguuauuuuuccccccuauuaauuuguucaguuggaagggcugcagcggcccugagcugggagaggagggccacugcugaccuccuccucgcugccuccccccauuuaccgucagcucagacugaaagggagaggcuggcaaaaucaaaugacaggucaaggggaguuaugaaacacgagagagaggugcuggaaaaaaugagaauucucccacagagaagggagaugccucugggaaaacuaaaaauagucagcugaaaacaaaucaccagggacagagaugagccacguggaaaauaagaaacacgaggggucacgugcacaugaagcagaaacaaaaaucuauuuacauccucaucaaacauuccugugacaccuaacgcuauucagcccaaaacaaauauaaaaacaccccagcuaacauauuuuacagaauaaaacugauuuaauuuacuguagcuguaaaaucaucuaggacaaaaguagcaacauaggccaacccaaugcccuaaaagugagcagacaggucaccacgugccuaaaauauauacuaaauuuauuuucaucuuaggcaccgaaaauaauaagcagauacaaacauaaaccucaggggaaguauuuugagacugcacacacuuuuauuaugaagauuggaaaacuagauuugugauucacuuacuacuuccccauaaccauuaggauguuuucugucagaaguguuuaguauacagaaaucuuuuagcauauuaaaauuaacugucaaaucugacugagaaacuauccaaugaaaaacgaugggaaccuucucaucuacacaggcgaacaggaaauauucuucuaaauuuaccuguguccuauuucccaaacacuggaacuaaaauauaauuuaacaggugcugauuuucacacauuuggcuggugauggagaaaagagcuagggaacaccaaggcaacaauucugccuuccaucaacacaaacaacacaaucugcugccaaaaguaaaaguacuaugcacuugugcugaagcaacagaaaacaauuuuuaaauuaagccucaucucucauuagagagagcuuuuuuccuccaauuaucugucuccuuggaaaaaccucugauaaacaucugcaaauuaaugaagacaucccccgugcaacacuaaacagagaucuaugcgagacagaccuguguggaaaacaacagugcuucuccuaaacccugaaggaagucgaagguuucgaagcaauccuuuggccgucagucguaugugaaugguggauaaggagaauuugggagacaacaacaugucuucggagcagguggcgagauuucacagaagaggcaauuuccauggacugucacauacugucuuuuuaaacucaguacucuucaaggccaagaaauacagucagaggaaagaugccuacacagcaaaugucauuccaccagagaggcauagaagaaaaaaaucccccagggcuggccaaguguuucuggcuuccguuuucacuuucagauguugccaaaaugaugcucuuccucugaauacaaucucccuccugcaggucuagaagcugccucugaaccacaucacacugugcaugcuuguggaguuguuaugguuuucauccgagaugguaaaggggaggagaaaguggguggucucaggagcuuuacagaacaaccaauaaugucacagauccuguaaccacuugaaagaucgcuaggggaaauuaacuacuucaagugccuaauguuucuuucauaauuagaaaaaaauuaggauuuccugaaaguaaacuguguccugauuuuaacauuuuucacuccuuauauucacaaugauaacaugagcauuuuuucucuagauauuuuacauguaaacuacauuuaaaccugguauuuuggaaaaguuuuuuuuuuaaagacuucaggcaauaaauguucucaacuacaauauuuaagaaaauuucuauucuaauauauuaaugacagauugucaaaagguuaaaguucaacuuuaauucccacaugcugaggaccucacaaauaaucaacaguaaaagauuaauacgguuucucuaucagauguaauaucagaguuccagaagaauaguccaucagauaggcauauucuaaagacuacauuuauugcaugaguaauugcauuuauagaacaucauguggucucuuauaguggucuuucaagacuaggagugugaggagggcacaguuaugaauaucuuuugccaguuaucuacuaauuuuuauuucaguagaguggcuuguaaaaguauguuaaaacaugauagcaaaaccaaaagaacuugaaaaacaaagauaugguuauaagaauuaacaacaacaauaugcccacuuaagcuaauuccauuaaaccacgaauagccugagcucuuaacauuuuuaaaaauguuauaaacaaaacaauguuuuaaaaauguccuaugccuguuuccaagauuuccuagaaaauaagacucagaaauaaaugcagaauuguuaccauaaauaacacuauuaagugcuauuaaaacuagcaggaagcaguucuuuuagaaauucuauagaguaggguaugaagcagggaagagagagggaggaagagaaaauuuaaauaaguucucuucccucaagcccccucccucuucacucaagcccccaacuugccauuuuagagguugucagcaagagagacagacccaauaaccuguccaggguuccugugagaaagauacaccuaguucauacacugacgaaaaaccugcuacauacauugcaccacagcaacugaagcuaaaugaucaaggaauuaaaaucaaggccagcugcuucuagguguugccuuuuacuucaucccaguuuauuauuaaaaaaccugaacaccuuuuccuuccagauucuacauacuaaaaauauaccagaaccuuuuccucuaccucccaaaaccuuguaaaaaccaagaaaccaaucagcauuaaaaacaaacagaagaacagagucaaauuuugccaugauuaaaaacagacaugccaccacuccauauaguaggaggugguuuuucuuucuuuugguuguguuuguuguuucuucaguaacagcaaauucuaaauuauccuuuuuuguuuguuuuuguuuguuuuuugagauggaguuucacucuuguugcccaggcuggaguguaauggcgcagucucugcucacugcaaucucugccucccggguucaagugauucuccugccucagccuccguagaugggauuacaggugcccgccaccaugccuggcuaauuuuuguauuuuuaguagagaugaguuuucaccauguuggccaggcucgucucgaacuccugaccucaggugauccacacaccucggccucccaagugcugggauuacaggggugagccaccacgcccagccuuaaauuauccuuguuaaaagggaaguucuuuagacucccuaaaagaagaaauuaccaucuaaucaucgauuaaucagauucauuaacauuuuuacuugaauuacauuaagcuauaaccacacauauugaaaauaaacauuguuaaugauaucucuuaacagcagagcaagaagcugcaggaauaaacuaaauucaguucuuucccaaacauagucugccuccugguggccgugcagcacaagugcaccaaagcaagggagcugccuuggcaguccauaaacaaauggccaucgcuuacaaucuacugcuccaagcacucucuuacacacuuuacguuugcucauuuaaauaacuggauaagcaauuacuuucaggucacaacuauuuuuauacuauauaugccucuggggggagccaagauaaaaaauugguuccaaaaaauucuuugauuauuugaucaucuguuaccaguuaggaacuccauauuuucugaaauugaacgaaugugagaaguaccuaaaaaaagcaucuuuguuauuuuuaaaagucuuaauuuaagaggaaaagauaggcaucaccaaggacaguagaggaaaaaauaaggaaauuuuagugccuaaaguacaacaguuuguaguuguaaaaguuagcuaugagucuuuaugggccgggcgcgguggugagauuacaugccuguaaucucagcacuuugggaggccaaggcaggugggaucaccugaggucagaaguucaagaccagccuggccaacauggugaaaccccgucucuacuaaaaacacaaaaaauuagcugggcauggugacaggggccuguaaucccagcuacucaggaagcugaggcaggagaaccgcuugaaucugggagauggagguugcaaucagcagagauugugccauugcacuccagccugggcaauaagagcaaaacuccucaaaaaaaaaaaaaagaugagucuuuaugaagcagagccuguguuaggaugucaguggaaaacaaaaacaugauuuaaaauuuuaugcaauguaggaucucaacauuaaacaaaaacgauuaaguauauuggagcaaacaugccagaaugucaccaaugcucugggagguagaagagggaggauuucuauuuuuucuuuauuauauguuuuuguauuuuccuaauuuuuuuuuucaaaaaucaugcagccagaaaaaaauuaaaaaguuuaaguguuagaauaauuuuauagaaagccuacaaaaugagccgaguuuucauaaugacacaaagaaaaauaaacgauguguaaagucuauacuaaggcuuaaauaacaaaagaggaugauacagaauguuucauaagucaguauguuguaauaucacaguauauucaaacaaacagaaauuccacuggucugcauagaaauguguuuuuuuaaaucagugauuuagaaaacaaugaugucaugauucuagacaagaaucuagcauaaucuguauggggugcuuagaugcuacaaaaugccuucaauuuaucuguuauuguuuguuguuguuaaugaucauaaagaaugaggaagaagauuaaaauuuaaaccaagugacuuguguggagauucaagcaucucuauccaaccaaucuuccuuagccuaauauggaauauuaaucuuuauauuuaucuccuuacuuucccuaacacagcauuaauugcaacauuuucuucauuuuacuccucacagucuuuaauguaguaaguucaauucucuauuccaguuguagaaacuucaacuuaaggcccaauuuuuccacacuauccucuuccucaguacgaagauaaauuguaauuaucaaaaaauuaacacaaagcaauuagaaaaacaaucaacuuccacccaccuguaagaugauaagcucucaaagaacagugacauugccuuuuauuuugcaauaagcaaaauaagaguuuaaauuaaaagcaguaaugcuuuuaauucauguacaauguuuguuuuuaaaaaacaaaaccucauauguucaucguagaauuuuuuuuuugagacggaaccucggucugucgccaaggcuggagugcaguggcgugaucucggcucacugcaagcuccaccucucggguucaagugauucuccugccucagccuccugaguagcugggacuacaggcgcccgccaccacgccugacuaauuuuuuuuguauuuuuaguagagacaggguuucaccguguuagccaggauggucucaaucuccugaccuugugauccaccugcuuuggccucccaaagugcugggauuacaagcgugagccaccgcacccggccagaauuuucuuuucaauuuaaauuacuuacacaucagacugcucuccaauuuguuuuuaaacuuaacauaagcuuaauaaacuuauuaaacuuaaaaauuucacacuuaucuuuccaugggauuaaauaagcauuuauauuguuauuuuaauggcuucaaaaaugucuuuaaaaugucaacgaacuuaauuccuguaagguauauagguuguuuccaauuuucccccauuguaaacaauucugaaaagcagucaauaaguaaauaaauuacuuuccuaggaccaauucugaaaaacagaauucccggguggaagguguuugcucucugcuacagcugcuguaauuuaccaaggagcuguacauaugagugcuguuucuuauucuucgccaguaccaggugcuaacauuaagaaauaagcaagaacugagagcacauuauuuuaacucauauuugguaaacauuuuucauauauuccuuaguccuucauauauuucuuuucuguccauccacuuauuuuucccuuucuuuuuguuuaguuuuuuuaauuguggcaagaacacuuaaugagaucuaccuucucaacaaaauuuuaaaagaacaauauaauauuguuaacuguaggcacaaugcuguaacaaacaucucgaaaaccuuuucgcccuugcauaacaaaccuuguaccauugaacaucaaguucccauucccuggcaaccaccacucuacucuguuucugacuuugacuauguuagaugccuccuauaaguggaaucauacaguauuugccccaugacugguuuauuucacuuagcauaguguccuccagcuuuaucuguaucacagcauauggcaggacuuucuucuuuuuaaaggcugcauaauacuccagugcacauauaugccauauuugcuuuauccuauggacacauuuagguuguucccacauccuggcuaucauaauguggcaaugaccauuguugcagggagucagggaccccgaauggagggaccggcuggagccacggcagaggaaacauaaauugugacgauuucauggacauuuaucacuucucuaaaaauacucuuauaauuucuuacgccuguccuacuuuaaucucuuaauccuguuaucuuuguaagcugaggauguacgucaccucaggacccugugaugauugcauuaacugaacaaucugauugcaaaauguuuauuugaacaauaugaaaucagugcaccuugaaaaugaacacaauaacagugauuuuagggaacaagggaagacaaccauaaggucugacugccugcgcggucgggcagaauacagccauauuuuucuucuugcagagagccuauaaauggacgugcgaguaggagagauaucguuaaauucuuuuccuagcaaggaauauaauauuaagacccuaggaaaagaauugcauuccuggggguaggucuauaaacggccgcucugggagugucuguccuaugcgguggagauagcuuggccgggugcgguggcucacgccugugaucgcagcacuuugggaggcuguggcgggcagaucacgaggucaggagaucgagaccauccugguuaacauggugaaaccccgucucuacuagaaauguaaaaacuuugccuagcgugguggugcgcaccuguagucccaguuaguagucccaggcaggagaauggcgugaaccugggaggcagagcuugcagugagccgagaucgcgccacugcaccgcagccugggugacagagccagacucugucucaaaaaaaaaaaaaaaaggacugagagagauacgcccuggucuccuagucuccugcaguacccucaggcuuacuaggauugggaaacaccaacccugguaaauuugaggucagaccgguucucugcucucaaauccuguuuucuguaaagauauuuaucaagacaauacgugcacugcugaacauagacccuuaucaggaguuucugauuuugcucugguccuguuuccucagaagcauguaaucuuugcucugccuuuuucccuuugaggcaugugaucuuugugacguacucccuguucauacacccucuccccuuuucaaaucccuaauaaaaucuugcugguuucgcggcuuagguggacaucacggaccuaccaauaugaugucaccccuggaggcccagcuguaaaauuccucucuuuguacucuuucucuuuauuucucagaccggccaacacuuacaggaaacaaaaauaaccuacauugaaauauugggggcgacagaccaugggaaugcaaguaucucuucaacauccugauuucaauuauuuugguaaauaacgccuuaucagacguaugguuugcaaauguuuucuccuaucucauaggcugccuuuucaugcuauuaaaugacugcuuugcucugcagauuuuuaaucugauguacuccaaccugucuauuuuugcuuuuguuaccugggcuuuuggugucauaccaagaaaaaugacaugaaguuuugccccauguuuuguuugagguguuuuauaguuucagaucuuauauuuaagucuuuaauccaucucgaguugauuuuuguguacugugugagauaaggguccaauuucauuauuuugcuuguggauguccaguuuucccaguacuaucuacaaaaagacuauccuuucccuauuguguauucuuggcacacuugcugaagauuagcuaaccguauaugcacggauuuauuucuagacuauuuuauuccaucggucuauguuucuauauuugugccaguaccauacucuuuuaauuacuguguguuguaauauacuuuaaaaucaggaacugugaugccuccagcuuuguucuuugucaagauuguuuuggcuauuugcaguccucugucauucuauaugacuuuugggauuguuuuuucuauuucuuuaaaaaaaugacacugggauuuugauagggauugcacugaaucuguagaucucuuugggugguauguccauuuagcuucuauuauagaguugucuuuaucuugcugauuugacagagcucuacacagaguaugugcuaauauaaccucaguuuguucuuugcuuauaaauacuguuucuaaugauuuuuauucuuuuuauuuuuuuugagacggagucuugcucugucacccaggcuggagugcgguggugcaaucucagcucacugcaaccucugccuccuggguucaacgauucuucugccucagccucaugagugcugggacuacaagugugcacaaccacgugcagcuaauuuuuuuguauuuuugguagagauggggucucaguacguugcccaagcuggucuugaacuccuggccucaagcaauccaccugucuuggccccccaaaguguugggauuacaggcgugagccaccaugcacagccuguuucuaagguuuuuuaaagcuuuuguuguccuaauuauuaaucguuucuauuauacuaguguuccuggaaagaucuuuucuacuuaagucuauauucuuaguguuuuaauuacuuuguguguuuaaaacuaauuuaucugaaauacuuuguauauaugugaaaaagaucuagcuccugcuaaaaagguagucacugucucaagaagauuuacuaaaugauccacuccucacaacccccaacaccaauuugaaacaaaaauguaucccauaugaaaagagcaucuguguuuuaaguauagggggaaaguuauguuaaucauaaaacaacagugaaaaaacagccuucucucuacucucaccagaagaaacccuggcagccucggcaucaccucaucagcagguuugcaacuugcaaccacuucccagcacuuggcaaaagaaggcaagaaagccgcccuguucuccugugaugucuuuacuaaguaacugcggaaggaccagugcauuuucuaccuuccaaggcagacacucuggcaccugagagugaugaucuuguguaaaccaaucaggguacuggauaaauacagcucugaugccucugguaugccaguggcuuuaguguaugguagaaccaagguaauaauaguauucugugguaugugugacaucuuccuuaucagcaguaagccaagauuuuuuuuagagucaauaucaacuacaaucuugcagcgucauaacguuuaaauaaauuacaacaguuagaccccaagagguugguucuugacuuuaagcagucuuuccugcuugcuuuagagauuuaaaauaauucaacuuccuggaaaagaacccuaaaaauaagccccuagaauuauaaaaacaauguaaaagaucgccaucauuaccguuccuagcagcugacuuaacuauuauuugagaaccuuuuauaaaacaauucuaugaugucauauuauugccuuucugggaauuauuuccccaauauucccaugucuccaaacgagaaauuugagacuuggagaggcuuagcaacuagcccaaggucaggacacaaauagaaagcagcaggacgaagguuuaaaccaacaucccgugccuuaaaaguucguucuccuccugcuuuucuacauugucuuaugagauaauguaauuucuuuaauugauaaaggucaagcuaaaacaaugauguaacauuuuaaacuauuauguuagucaaaaaaauuuaaaaauaauauccaauguugacccaagguaugaugaagccaggugucuuuuaugucaaccacgguauaaaaugauaugaagcuuuuggaaaacaauuuggcuauuugagugaagugacuguaaauggguacauauugugauuuccugauacuacuuuuaauaaucuaucacaagaaauugaaaguugaaagugcuaauuguauagauguucaucauagaaucauuuaugaaugugauacagaagcacccuaaauauucaaaaguaguuaaauguuacuguaucugcuaaauguaaaagugauuacuauauguuaaaugacaaagcaggauauacacuuaucuaaauuucauuuaaaacgacaaauuuuaaaaagcugaagggugauuucuaaacuacaugcuaaacuuuuugaaguuuggcaaacugcuauaauuaaaagugauuauuuuacuagaacuaaggaauaugaaguuggucaacucaacuguaaucuccaccacuacuuacagcuuuaaaauaaaaauaucucaaagccauaguacaacgauuaaaaauuuacacucagaggaacauguuuauguguggaggcaaugucuucuguaucagcuaaaauaugacucauuuccagcagaauaugaaaaaagucaaggugauuuucagucacagaauaucacaguagggagaaaucuagaaauccacccuuucaguuacauagaaaacuauuaucaaagagguucaaugauccacccaaagucacuggcuuuucagcaucauuuuucagcaucaaagucgucuuuccaaagcaaacacacuuuguugugguccucuguccacacaguaacuuuuccucacuaggcuccucauaauaccagguuagucuuaagucaugauaauaacuaaccaucgagaagaaccugggaaagucaugcuuaugguuucgggaaaauacagaggccuaccacacaaucuagauuaagcugcaauguugaccccuuagaauacauucuauauauacagagucaucuauagauucaauguaacagaaauuauuagaauuggaauuauuagauuacauuccuaaaaccucaccugacuucauuacagagauugacaagcugauccuaaaauucauacagaaaaucaagggacccagaauagccauaacuaucuugaaaaagaaagacguugaaugacucacauccugauuucaaaacuuacuaaucaagacaguguagcacuggcaaagguaacauauaaaugcaaagaacacaauuuagaaaucagaaauaaacccucacauucuuaaccaauuauuuuuaacaaaggugccaaggcauuuaaaugggggaaauacaugucuucaacaccuggauguccaugugcaaaaaagaauuagaccuucuaucucauaccauauaaaaauguaacucaaaaugaaucagaaaccuaacuauaacagcuagaauagcaaaaaaaacuuaaaugaaaacacaggcuuaaaucuucacaaccuuggauuaggcaacuguuucugagauacaauaccaaaagcagaagcaacaaaagaaaaaaaguugauaaaguggaccuugucaaaauuuaaaacguuuauguuuccaaggacauuaucaagaaagugaaaacacacccaagaauugggagaaaauauuugcaaaugauaacucugacaagggucuaauaucagacuauacaagaacuccuacaauucaacaauaaaaaugacccaguuuaaaacuggcaaaugauuugaauagacacuucuccaaagaagauauacaaauggccaguaagcacacgaaaugacacucaaugucacuggcugucagaaugcaaauugaaacaacaaugagguaucacuucauacccaguagggauagcuauaauaaaaaagacagacaaagccaaguguugacaaggcuguggagaaacaggauucuucauacacuccuggugaggauauaaagugguccagccacuuuggaaaacagccuggagguuucuuaaacuguuaaacacagagcuaccaauugagccaguuuucugauaaugguuaacuaauuuuuaaacaaagccauuccauagaauauuagcuaucuuuuuuccccagauauuaggauguaccagaaacuuaaaaggaaauaaaagccuaaauguguacagcagaguuucuucugcauuuuuacccuauaaaggcuuuaguaaccacauauauucacacucagcauccuggggaucuuuagaacuuagaucauucugcauggcugucuuccuagcuuuaagagccuacaaaagguuacgaauucugagauagcugggcgcagugacucacgccuguaaucccagcacuuucggaggccgaggcgggcggaucacgaggucagaagaucgagaccauccuggcuaacacggugaaaccccaucucuaguaaaaauacaaaaaauuagccgggcaugguggcaggcgucuguagucccagcuacgcgggaggcuaaggcaggagaacggcgugaaccagggaggcagagcuugcagugagcagacaucgcgccacugcacuccagccugggcgacagagcaagacucugccucaaaaaaaaaaaaagaaaaagaauucugagauaauuuccccacacuucccugcuuauuacacugaggaaacugaauacaccugauggggcaucaaggauauuuguuauucauguuauucaugauguaauguuaucccacccuguuuucuuuacacaacaggcucagaaauuuauaccucuugcccagguuucccucacaugacagccuucaauccggaccucucuucuaggacaagacaacccuccuuccuagaacucagugcauuugugauucaugucuauuugagcagguuuuuuauuuuauuuuuuuaacuauccuauuagcucuccagagacaaggccccugcucauucuucgcucaggacugcauccuuaacaccugacacucacaaugugugaacaaacuguagucaacauucuguaacauuacaugcauaccugggagauauauaucaccccauaagacacaugacauaauaaggcaaaucacaaaaauugucugguuucucagugcauauaaaacuuauauuaacacuacacuauagucuagugugcaacagcauuaugucuaaaaaaauauauaccuuaauuugccaggcgugguggcucacaccuguaaucccaucaguuugggaggccgaggcagguggaucaugaagucaggagauggagaccaucuggcuaacacggugaaaccccgucucuacuaaaaauacaaaaaauuagccgggcaugguggcgagcaccuguagucccagcuacucgggaggcugaggcaggagaauggcgugaacccgggaggcagagcuugcagcgagcagagaucaugccacugcacuccagccugggcgacagagcaagacucugucucaaaaaaaaaaaacaccuuaauuuaaaaauauuucauugcuaaaaaaugcuaaagaucaucugagccuucagugagcaggaauuauuuugcugguggaacaucuugccucaauguugguggcugcugacugacugauuaggguagugguugcugaagguuuggguggcuguggcaauuuaaaguaagacagcaaugaaguuugcgacaucaauugacucuuucaugaaagauuucuuuguagcacgugaugcuguuucauagcauuuuacccacagcagagagucuuucaaaauuggagucaauccucucaaacccugccacugcuuuaaguuuauggaauauucggacuccuuugucauuucaacaguguucacaucaucuuuaccaggaguagauuccaucucaagaagauacuuuauuugcuuauucauaagaagcaacuccucaucugcucaaauuuuaccagagaucaacagcaaugcagucacaccuuaggcuucacuucucauucuaguucucauccuauuucuaccacaucugcagugacuuccuccacugaagcacugaaccccucaaagucauccaugacgguuaggucagcuucuuccaaacuccuauucacguuggugcucugaccuccucccaugaaucacgaauguucuuaauggcaucuagaagagcaaacccuuuucagaagguuuucaacugacuuugccccguuccaucagaggaaucaguaucuagggcagcuacagucuuacacaauguacuucuuaaauaguaagaccugaaagucaaaauuacuccuugauccaugggcugcaaaguggcugcuauguuagcaggugugaaaacauccaucuuccuguacuauacucuuguacuauauauuacuauguaauacacuauacuauacuccaucagaguucuugggugaccaggugcacugucagucggcaguaguauuuugaaagacaucucuugaguuguaggucuuaacaaugggcuuaauauucagcaaaccauacuguaaacaaauacgcugucauccaggcuuuguuguuucauuuauagagcacaggcagaguagauuuaacguaauucuuaagggcccuagaauuuucagaaugguaagugaacgucagcuucaacuuaaaauuaccagaaguauuagcuucuaauaagacagcuugucaucugaagccaggcacugacuucuccuguuuaccugugcaaguccuaaacagcaucuucuuucaauaugaggcuguuucaccuacacugaaugucuguuguuuuguguagccaccuuuaucaaaugaucccagcuagaucuucuggaugacucgcuguagcuucuacaucagcacuugcugcuucgcccuguacuuucauguuaugaagaguuaccuuaaaccucaugaaccaaccucugcuagcuuccagcuuuuuuuuuucugcagcucccucaccucucucagccuucauacaauuaaagagaguuagggucucacucuggauuaggcuuuggccgaagugaaaguugcagcuggcuuaaucuucuggucagaccacucagacuuucucucugccgggagucuguuuugcuuucuuauuugaguguucacuagaggagcacuuuuaauuuucuucaagaacuuuuccuuuccauuuacaacuuggcuaacugcuuggcacaagagaccuggcuucugaauuauccuggcuuucaaugugcccuccucauuaaacucaaucauuucuaucuuuugauuuaaagugagagacaugcaacuuuucuuucacuugaauauucagaggucauuauagggcuauuaauugguuacuuucaauauuauugugucucagggaauaaggaagaccaagaaaagggagagagauggaagagggaccagucaguggagcacuugaaaugcaaacguaucagcuguguucacugucuuagaugagcaugguccauggugucccaaaacaaucacaacaguaacauggaagaucacugaucgcagaucaccguaaaagauauaauaauaaugaaaaagcuugaaauagugugagaauuaccaaaauguaacacacagacaugaagugagcaacugcuguuggaaaaaugaugcugguagaguugcaaaaagcacaguauuugcaaggcuccagaaaaugagcgaugcuuguaccuucguuucuucugauuugcucuucuaaucugccauggauuuagaaggcacauaacuguuuuaucacuguauauaaaauaagacaauguaggcaguguacaggagaccuuaucuaucuagagagaucaauccaucuaucuuuuuuuuuuugagacagggucucacugugucacccaggcuggagugcagugguguaaucuacgcucaaugccaccucugccucccagguucaagcaauuauccugccucagccuccugaguggcugggacuccaggagcguaccaccacguccggcaaacuuuuuuguauuuuuaguagagaugggguuucaccauguuggccaggcuggucuugaacuccugaccucaagugauccacccaccuuggccucccaaagugcugggauuacaggugugagccacugggcccagccuaucugucggucugucugucuguccauccauccauccauccaaaguauaggaaucgcagugaagauauuuugugaaaucuuuuauggguucuugagagacauaaaguuuuggauucucagcugugguucaaauaguggaggcugcaggcuaucuugggaauguuaaguccagugaaagugugaaaaaaaaaacauaaaaauauaggcugcugaacugggaaaaggugcuaaaaccaaauauugagaccacuuaaaaauuaaggaauauccaauuucaaaauagcauugaucuugggggaaguacauuuuccauuucauuuagaccacauuaacaaaaucauuuuuuaaaagacuauaacuaucuauuaguaauacaauguccuuucaugcauuagauggccagucaugcuuaccguauuuuaaugcuaugcgacccgucauaaaaaguuagguuuacaccucaaauuggaaauucuacuuauaagcacaccaguaaaaaaucacuguaaauacuuguaguaacauaacuuuacaaaaagauucuuuuuaucgccauccauaaaguggucacucaccugcauuaagagcuguaaauaaauuuuuucucgaaggaccuaagauauaaaagaaacauguaaaauacauauguuuuauuugacauaucacauaaaaacaaaccauguugauaagaauuauuuucaaaaacaaucaaucgcuacauuucagguucccggugggaaauaucaccgagauucaaccaacuuuugucaagugcauuuuaaauauaaggugauauuucacauaacaucaaaauguuuaaguaugauaugaagucaccacaaauuaaauaggaccaguuuuaaaaggaaaagccgcaguauuuuuucagucaagaacagcugaaguucaaguuuuaacaguacugaauucacagacugugcacauaugccauucugcugccgggagagcagaggccagacuucacgaaggacagucacucccgugugcuuuccgaaacuacccguuucuauucagcuaugaagaaaaauagaaguuuuuccuccaaacugauaaaauauaaaaucaggagggguaauagguacacagcuguaagucacuaaaagaaaucuaugaugcuucuacuuaacaugaaauaguuguuucuaggacauaaucaucugcagauaccaguuagaacagcuaccauguucuaucugaaauuuuacagagaugaugaucucuuaaaauacguggcuguuaucaauggaaagcacugauucccacacagguaaaacuguugcgacauaaccuauccauucaauagugaggcauuuuagaauucugagucuccuguucuacaaagcuguccauggaaucucauucucugcaaguuauuuuaguaucaaaguucaacagcguuaacuucauuauugcuguguggaucauggggcuuuaucaucaucaauaaaaaaccacaguuuuccaaccugaugucaacucagcaagaggucauuuggugccuccgaaauuugauuaacucccuaggcaaaugacaaccugcugcacacugaagaauucaacccacuccuaaaauucaugccuauuuucucuucaauucaguacaaagaaaagguauugacauacauuaaccagccucaagguaccauauuauccuuuaaacacacacacagagagagagagagacauguuaaggaggaugcugugacagaguaacaccucugagaaaguuacuaauagauauuaacaauccaaagaguuucaugcagguuaacccaguaauuccuccuucugggauauccacaaguaaccagaaucugaaacaaugaaucuugacucacauuugaagagguucaucucaguauuaauaaaccccaauaaaagucagaaguugcccacuauaaacugaaguggacaaccauagaauagccauuuaaagugaagaagcucuccugauacacuacuaacuuaauaaaaagcaagauacagaagaguauauucauuauuaccucaguuuugcuggaauaaaaacaaaacaacauauacauacagaggaaaaaagucacaaggaaaugugacagcaauugcugguugacagaauuaaggaagacucuuuguuucuguguuuuccaaauucucuaacauaaaugugggucucauuuuauaggucaaguuucucacucacaauuauucgcucaggcuuuaguuaagcuucaguucacuaagcacaaauaaugcuuuuuuuuuuuuuuuuuuuuuuuuuuuuugagacagagucucacucugucacccaggcgggagugcaguggcgcgaucucggcucacugcaaccucugccuccuggguucaagcaauucucaugccucagccucaugaguagcugggacuacagguacacacgaccaugcccagcuaauuuuuguauuuuuaguagagaugggguuuugccaugucggccaggcuggucucaaacuccugaccucaagcaauccaccugucuuggccucccaaagugcugggauuacaggcgugagccaccgcauguggcacaaagaaggcuucugaugugcuuuggccccacugagacaaagcugcaugaaaacauugcacauuaaguguauaccacauauuuuguaaaccugaaaauuacuuuucauaaucacagcaaauaaaaagugagggauaugagaaggaacagagauaaagaacauuuagaggaagaacaaugucuuagaccaaagacaugaagacacaaguacaguaauaaacauaaaacaucuacccugaugaaaaguaaucaugcauuucuacuccuuucucacuauucuagagcacuguuuuagaauaauuuaacuccugaaguuuugcuguuucuaccuuauaccuuuguucugccugcugacuuacacguaaugauuuuuaacuauagaaccuaccaacugucagaaaaacaauuuccucagugcaaaaauguauuauaucuccuuucucaacauauuuguaaucauuguugacuauaccauaaaccuaauugucaaaauuuaacuuucuacaagccaaggacuuuaagcgucuugcccucccucuucaaaccacaaugaggacuguaccuuuuggaggaguuuucaucaagugaacaugagcccuggauaccaaaggcuucaaauaaaaggauccugaggaaccauucugaaaugcugguuuuggagguuucuccucauauuugaugacagcggcauuaccagcuguaauaaaacagaaaaguacauuuuauuguauagauaaacacaguuucgaccuuccacauuuauuccuuuguccuugaaccaacaaaugcucaauaagcaccuacgacaugccagucauuacugaacauugggaauacaacauggauaacagguagcuugugucucagggaugcgaaauaaaggcuauaaucagagugaccacacauccugguuagccuggcacaguccaagcuuaugcaucuuguccaguucagcuuucaucccagauaagaguuggggaagaaauaauacagccacuucaugcuauguaacaagaaugccccaggugcagcuaggaagagcacccaucuccauggggacaaggaagaauucgcacagucagcuaguuaaugacacaagaacaguaacauacagacuccuugguagcuauaaggacacgcucugguucaaauccuugcuccuacagcaaggaguuaaaaugcuaacuucugcccugaacaaaggaaguuuguuccaaaguaaacuuuauguuuuagcuccaaagcaaaaacauaaaagggaaucuuaccucaauaacaaaaaccaucuuuuuauauuauguguaaaaauuuccccuccaccaauccagacuggauuuucuacuguuuguuuguuuguuuguuuguuuugagacggagucucacucugucguccaggcuggagugcaguggcaugaucucggcucgcugcaagcuccgccucccggguucacgccauucuccugccucagccucuugaguagcugggacuacaggcgcccgcggccacacccggcucauuuuuucuauuuuuaguggagacgggguuucacuguguuaggcaggauggucucgaucuccugaccucgugaucugcccgccucagccucccaaagugcugggauuacaggcgugagccaccgcaccuagccuguuuguuuccaaauaaugaucaauauccaauucuaggcacccaauucuauucuacuauucaacgcuuauaaauuucuuuauuaccaacuaugaucccuuuucucacuucacucacuuagcaaaggguuaagauaccuaccuuguuuacaaaugcauuauaaaugugaagacagcuagaaauuuuucacuaggcuaaccuauuccaacugcuacaauagugcuuauacacaucacauucaaacuuuguacaggcgugcuauuauuuuccccuaauccacacccaggcccuguacaaugagccaucuguucauuguucucgugcccaaauaacauuccuaauauuaggucaaaucaacacagagcuuucccuccugcugagaaaauucugucaauuuccuguccuuuuuuccaauucucaccuucccuagaaccuagagacuuggcuuuuccaaaguugacaggaagcuaaugggagugacaguauuaaagacaccgccauuacaacauucaacagaacccuuuuuagauguucauagaaaauggauauuggguuucaauuagcauuuuagcuuuugcugaaucaaauccaacaaagaaaauuagacagucuuaaccauggaauuauaacaaucuggauuuuagucuuacuuuucuugaagccguauuugauuauauucagcaacaaauaagucacuuauucauauuuuaaaaaauuaaacugaguucaauuuacagaccuaauaugcaauuguaugauucuaaauucaugcuuuucuuuucuaaaauuuagagacacaaaggcccacgguucacaaagagaucaguaaaaagauuuucacuaaaguaaaggacagguucuucaugagggaugguacuccugugucccuugccucucugucacaugcaaaauaggagguggugugcuggaaaucagcugucucacugccacuuuucagacucaauacaacacuagaucaacccggcaccacacccaucaucagcuucauaacacgcaacaugaagucagaauucauacugcaaggauaaaaugucugcguuugacucagguacaaacacacaugcauuuauauuuuauacauauuuacaugaaagcuauauauacaagauacauauucauauacucuaugaucaacgauuguaccugcuuucugcuuuacuaauggcaggcacaaccuguacugagcugaacauaauuuuaugacuaacaauaucuuucucucaauuucuacuuacuguacucuaggcuggcccacugcuuuccaguaaaccccaacuugaaggauguauaccaccaugagucauaaugcucuucaaauauuuccccugcccucuauuucuguuccuaacauggcaacugacugaguauccugaugcuaucuaaauuuucccucagccagagucauuauauccaaacaauaaaguccucagcggcaacaauuccaauauaagagaugcauaauaguuuccagcaauggaacaggauguaaaauauccuaguucuggugcugacuugaccacugccuagcugugcugaaucaccuaucuaugaauaacaagggucugaauaucggguaugggaauagacagugcauucgcccauaucggguaugggaauagacagugcauuugccuucacaacucacugugguauucagucccacugaggcuggaugcauccucagaaucauccuaaagacaguguucuagagagccauggacacuaaacacugcuggcuugaagagacaauacauaaaauuuuucauguggccaccuacuucucaaccugaucuaauauguaguuuaaaacugccccuuugucaucuuuggucccaacugucucaauuaugccagaauaacagauucucuggaaucuuuaucuucauuuccccauggccaaagugugguucaagugaaauaaaggagcuggugagucuaaaaggaaaaacuaagggauauucucaggaaagcccaagcagaagacaugauuuuccuauuagaaaagggcuucucaugcugggcacaguggcucacaacuguaaucacagaacuuugggaagacaaggugggcagaucacuugaggccaggaguuugagaccagccuggccaauauggcaaaacccugucucuacugaaaauacaaauauuagcuggacguggugguaggcaccuguaaucccagcuacucaggaggcugaggugggagaacugcuugaacccaggaggcggagguugcagugagccgagaucgugccacugcacuccagccugggcaacagagugagacucugucucaaaaaaaaagaaaagggcuucucauuguuucagacuuuuaucugcaaacuaacauucauacuacauucuaacaccuagugaaaauucgcuuuuauuacauuauguauauacacacagagccaacauucuguucauuucuugaauuuuaugugaaucaguuuaacacuccccacugugccagaucaucugcccacuuggcuuaaaaucaaaguacuacugaaaucuaaacuuuugaauuucaaaagcaauaucacucaacuauauaauaacaagaaugucucacauauacccuagaaaaacgugaacagagaaagaacgagaacaaaguuaacaguggucuggauaauauuuccuuuuuaaauaguccauucagaagugcguaaguacuaacauguuuugugauguggagccuaaugaaucuaccgccuguuccucaucuuagccucacccaugacagacaucacgacuugaacacaaaacuuucccucugaaccuggaggcacccugagaaaccacugacaccauccuacaggcgaauucuuauccacuaaccaguguuggccacuaaccaguguuggcaggugagacaauauucacuucccauuccuguugugagagaagaaaaaaaacaaaaaacaaaaaacuaaggguaaauaagauccacccuauucuuuaucagcuuaaucacuugaacaacucaaaacaccauccugccaaacaaugaggcccugucuuauugcagugaaaagggucagaaauguuuguugcugcaaggacuuugaagaugacccaguccucccuugucauugaucagaggagaguauggaggcuggaggcuaagaaaagacaaagauaguccaacuuaacaugaguuaguaggaaaacuacggugggaccgggcgugguggcucaugccuguaaucccagcacucugggaggcagacgcaggcauaucacuugugguuaggaguucgagaccauccuggccaacauggugaaaccccaucucuacuaaaaauacaaaaauuagccgggcaugauggggcaugccuauaaucccagcuacuugggagguucagacaggagaauugcuugaacccgggaggcagagguugcagugagcugagaucaugccacugcacuccagccugggcgacaagagcgaaacuccaucuaaaaaaaaaaaaaacaaaaaacaaaaaacaaacuaagguggguccaagguuagugcccuuuucugcauguuacaccccacucagccagggcugucagugaaggugaagggaaagaacacuccauuucuuuuauucagucuccuucuguuccuuccauuuccaggagaaugcaaauagcuuuggucugcaccucuuacauuuccccuaccaucuggcucucaaauauaaacaugguuuuguggccaaaguggaagaggaaguaaugucuuuggaccuuacuuuccugcuaacaucgcaaaguuauacacucucccaagacccccuucuaaauugcacaauaguccccaaaucuucaacucuguucaugacauacaauauaucauuuauuuuuacccaguuacuuuaaugaucuuaaaaacuggauauuagguaucugagugugaaagaccuuauaaucuuuaaccucuauaaaugagcacauuugguauagaaaccauugugaaauguuuuacacuaauauccaaaaggaucaagaucguaacuuugaaauuuucuacacuuaaaagaacacacacaaagaaccugcuaaaauucccaaauaagaacaauuuauugccuuacguauuuugauuuggucauuuaaaaaauuuaguaacauuauuucuauaggaucccaaaguuccgagaacccagugcuaauuuuacaacagcacuguguuauaucagaaguucuuaaaugaugccacuaaagauaucacaucacaaagaaacaagcagacaaagcgagaaaccaauauuuguuaaagggauucaaauacuuaagccaguauaaaucagaacacugaucaaaagaggaaguuaauucuuaacaugaccacccauuaucagaaacaggaaauuuucagcgcgagaugauuuuuucauguuuugagguagccuuuaaaaguauacauguuuaauacuuucaguuacaacuuaggaaaauaaagaugugauguuuccauuuuaauuuuagaaaaguauuuuucuacacuugcacaacuaccagcuacauacacacaaaaacuaguuauuucauaagaaauuaaaccaucaaaaagucuuugauaauaggauaauuucaugugccagaacauuaacgaugcugcugaauuauauuaagagugcaaaacacauaaaagagacaacaaaauugguccuacacagaagcauucacaucuuaaauauacauacaaaaugcccccaaauacuaccauuaccauaaauuacaaguuacaaaaacagaagucaagagauccuaaaucaauuuauugaauaaaaauuuaagcaugcuuacaaagaaaagaaaccagaaaucgucgaccuacuuuuuuucccaguaaacguggcuaacaaaggaauuauacaaaggcuguacgaucccacgaccagcagugucaauaagguagcaucauagugccucucugaaccagccgguggggugaguguagaauugauaaagauuuuugaagaaauaucaguuucuguacaacugcgaaauccuccugguacagucauuuaaaaggaucaaagcaagcuuaagcaggaaaaacugcagccauguucacucucauaucccucaugcuugcucuuagugaauucgaauggagggaaaaaaaaaaaaaugcguaagcuccaaggcacuacacaaaacagauuaaaccagcuagcaaaucaaacuaagaaagagacucacugauuugaaugcuuaauccgcaacaggaacacaucgccacuagacaggcucuguggguguaugguaaaccccuuuguuaaaagacaaaaaggaauggacaaaagcacuuuacagccuccuuaggagcaucagacacaguacugaaacgguggccaagucaacauggaugucgauggaaaacacggggcuguggcacuacagacugugucugcuucaagugccacaaauucuguugccacaacaguuuuucuagagcauguuggugauucuguuuuggcaguuugucuuuaaaauugcuuugcaagacaaagagagcuuaaaauaauacacgugugaauuaccuuuucaaauucagaguucccucuuacaugcaagccugauuuugugccacaccuucaaaauuccaacaguaaagcugguaacaauccuguuuaauugcaagucacauaucccaguauuccugaagugccaggguaugcagcuacuuacucucauaugaguccagcuacugcugcuaggugacccgucggaaaugugcucauuaauucggucauuaauucaaugccuucucuacaaaaaaugcauucucaauucccucacauagcugcugugugauuuuagaccagugacaacaucucugagccucaaucaccuucuauauaaauaucaggguaacagcagaaguuaccugagagaaaaaaauaaaagcaaauauggacauccuaaaguacugcuccacacccagaggagccucaugagcauuauuacacuuuguccccaacuccucacccaaaagaagaaacugaucugucaaacugaagagaucaguucgccacuccucuccacacccuugugucugguuuuauugguauucucaucauccaugaaaauaccuucuuuuucuccucaacuauuuuuuagaauaagggccauuucuuuuauauccugugcuccucacugcgccuaucauggugucugugcacagcgggcacuccaagaugguuuaaauuuaugaauuauuucguggggaaguauaaaaaaggaaaugagaaaauaagaaccaaguccaaauacaucuuuggaaugaaagagguaucucaguaaauucacucauuuauacacagaaaauagaacucacguuaacugaaaacuuuaacaaaauucuccugaguuucaauuuuuuagaauuaggauucaaguuauauuaguccuauuacacaaaaucuagcauccaaagauuccacaggagauagucuuuugcaaaguaaaugaaacugaaauaaucuuuuuuucugauuccaguuagaguccaaauccccuggguugcuacucuuaaaccuccaaaacaccaucacuucagacgaugcacuuucgaauccuucaugcaaaaauauacuuuaacacauaauuauuucaagaguguuuuucaaagaauuuuuuuucugccaaacuuucagagcaacuccaaggaagcaguaugccuauuuuuccugaaaccccagaaacaaaaauucuaauuauuugcagagcauuaguuuuucuuguaaugacuguuuccacaacccccgaagugugauauaaagucgacuuacaauuguugcuguaagugcucagcucacugugggugcuggcuauugagggggugcuuccuguccuccgcagcgcaggacuuuucaaagaugcuuuggauuuaggaaguggucuaggcaaauucacccaugacgacugugcaguuuucaaggauguaggcuuuccuugggguuuaaaaaaaacaaaaaguuuccagugcuauucaucccgaaagcuggcacuuuuuaagccuguaaacucaaacuucugcacuaacaacaaagucaaaacacaaaaugaauguucacaaucauguaacuucagaugaaagaugaaagcuucacgcagacauguuuauuuuugaucauuuagaggcaagagagcagaaaugaugaggcaauuaggauaugagaaguguaggaguaacccugucuccuaaaguaauuaacucacacauguucucugaaggagaugaucaaucagaauaaucaugagaaagcagcuuuuggcaaaacugaaauaaaaaaauaaacaaauugauacgaccccccauacuggugacuaaaaaaaaaauaauccauuaggacaauaggcuaucauauaagaaauaaauaagaaccaaguccaaauacaucuuuggaaugaaagagagaucucaggaaauucacucauuuauacacagaaaacagaacucacguuaacugaaaacuuuaacaaaauucuccugaguggaaaauuuuaaaaucacccaaacaggaagaaaaaugcaauuugauaagcaaaaauuucauuugaaaaaugccuaauguucuaacaccagguggugcuauacuauuaagauuuuuuuuuuuaaucucaccuuuucuucuuuacuccccacacaguuuauuugccaaacuuaaaugaucuucacuccaacuugcaacucuuucuugcaguaaaaauguuuccacuuaucagugaaauaaauauacaggcugcguauccucuggcaucucugaaacuacauucuccugaugcucacgaaccugcuaccuaaauaugggcauuucccaagcccagucuuucgcucuuaacccuccucaugcccauucucuuggagagucuauuuucucuacuuuccucuaaccauuguccuaugcggaugaaucccauguucucaccugcagcccuaucuuccuucugaaucucaaggcuacucauguuuuaaaguacuuauugaguacucuagguuuucaucuuagaccgacaugcuccuguuuaugcuaauuauagcuccacuguuuuauuuuuuuaaaaaucuugcuuuguugcccaggcuggucucaaacuucuggccuuaagcaguccucccgccucagucucccaaacugcuggaauuacagguguaaaccaccccacccagccauauagcccuauuuuuuauuuuuuuccagcuucaaaccauuggaaucaucuuuucuuccccagauccccauauauucuagcacugucucccaaugcuaccaguaccaccuaacugaagacuacccagaguugaaaaagaccuuugaugaaaaugacauuguugcguaucacuaaggaucccauaagugagucaaauaaugcugcuggaaaguaaugcccauugcuuuguucuagcgauuuugcucauaaaaaccucauccuaauggagaaaaagaugcugaagcuccucaggccuggcauuugaaauuaccacauuaagcuccccuccuucggcuccagccucacucuuguauggcucuccuacauccaugugugcucugcuccgauuaaccucgcuuucucucugacaccagggcacaucaugugcuauucuauuaauauuccaacaggcacaucauuucuuuucaaagagcucuucuuccacccuuugaauccuuauuuaacccuuuauaucauugucuaaacuguauuggacuccuaaaauccuguccuuccaucccuuccaacuccaucauguuaaucuccuaaaugugaaaauuaaggucaugacccaaucuaaaauuugggauucuccaccaucuacagcaugcggcccagcacagcuuugaacgcuaacccaauacaaauucauaaauuuucuuagaacauuaugagauuuuuuugcaauuucuuuuauuagcucaucagcuaucaucagcauauuuuauguguggcccaagacaauucuucuucuuccaauguggcccagggaagccaaaagauugcacaccccaaucuauaggauggugaucguaguuucaauccuuuuauuuaauauuuaauuucacaggcuuaaaaggcaaugugggguugaucccuacccacuucuucccccucaggccaugccucuaccccuucauacacacacaccccuucgugguuucucuccagucauuucgcucuauucuucugcuuacgcccauccuuccgacugaacggccuccuuucuauccccuccccuauuucuguccagugaauccaaagucagcucaagcuucucuucugaacccuugcuacucauuugcagcuccacccuaggccuacugaaucaccaccugcaguuucacaagauccccaggugauuaaaaugcaccuggaguuucugaagcacuguugagaaucaggaccucucugugagcuuauccugccaggacacccuucucugaaugccguggacuaagccuugcuuucuccucacaccauguacuuguuucuaucacagcauuugccuccacauucuucuuggaccaucucuaagguuccugagaucaggaagagcaccugauucaauucugguccucaggaacuggcaaaggucuagcauggagugagacuuaauaaauguuuccucaacaaauucauuuuuuuaaaugccaacaguaaaugauguauuuugauaauguguucucccaucaucuauacugaagcauucagugcuuaacccauuuuuacaagcuuauuugaaucuucagucuauuagagacuuuuuucuuuacauccuuuacaauaauuagcaacuguuagauagcaaauacacacuuuaaaaauuuaugguuagccaccaguuuuacuugcuuuaggaagaacaggaaaacagauuuuuagaauauaaauuugccaaauugccgccccuucagcagaaacacugaugagucaucaucaaaacuaauaagcaagguugggcacguaacagaucaaaaugacugggccacagccacagugcagccaaggcuuccuacauuuuggaaaucagcuuauucuucagaaaugcaugccucauagcuuuguuucuaaacacaacuuagguuugcagacauuucugagugugccugggaauuacuacagaagaccuguaccuucacacagcugcacuagaggaaagcuuaccccggcaaccaaauaucauuucccugaccuccccuaucucauugucacccccauccaggcccauccccuacaccuaauggcagccaguccucaccaaagucuucccaauuccaccauggcucuugacuaaugagcaaugaggauaaugaaugccgauuucaccaaaagauuaguuucuuugauagaauaauccuaacagugugugacuauuacuaucccaguuaauagaugagaagacuacuuaggugguuaaauggcuuacuugggucacauacccggccagugacaguaaggccuagaauccaagugucuaaccaccugcccaguguucccucggccaugccacagaauagaaacaucucaguuaaagaaaaguaugaggcuuggaggcagacagaguucagaauggagcucuuacuggacaggagcuccuacagcggaauggugaaaaccguacggaugcaacaaagacauauaacuauuucaccaacagucccgacguuuagcuuaacgguaaaguuggcaauacuaaaacauagcaauauuagguuaauugagagacugcaaguaacacaggcgcuaaauucuuaaacagugaaaucaauacaggacuucucugaguuacaguuccgaaaaggugacauuuaccaggucauaucguauuguguaacuuaucccagaugagaaagauaaagauuuaagaucuacuugcaggauauuauugaccucagugguuuauuuuaagcucgugcacuuagcauagacuuacguauagacaacagauugguuuuuauucuguaauuauaaccaucuuuuauguagggaaaaucuggaaggaauaacaccuccacuuugccuuagauaguaacacagucuauuggauuugaagcaaaccuucacuaaucaaccaauuuacuaaaauacucaccucagaaaaccugaguaaguauacuauauuuaacaacaauaaaaaucaguaaaagacgccuagcaaaacuaaaauuucaauggaaagauuaagugaacaacaggauaguguuaauauuaauauuauccuauucuguaaaacaaaaugguagaauggcgcuugccaggggcugguggggaagggaaauggggaguuguucaauggguagaaaguuccaguuaugcaagaugaauacguccuacagaugugcugcacaacuuguguuguaggaagcugggauuacacccacacaacaccacacccggcuaauuuuuuuguauuuuuaguagagaugggguuucaucaggcuggucucaaacuccugaccuuaagugagccacuugccguggccucccaaagugcugggauuacaggugugagccaccgugccuggccaaaacagaucaucuuaauaaaaaucuggacaauagauucacaugaaggugugucuuacacaaguauuuaugugcuuaccuaguaaggcaagugcaaguaaucacaaaguucaaacauauacagagccagaaccaccugacauccugccacagaauuagacguucucaguaaaaacuguaaacuaaagaaaacaucaugucucaccauaagguauguuguucuguaguuuauacagcuuaguaggaacacaggugggaagaagaaaauaaggcuggagaggcagguaguuuacaguugggugagacauggcauugaaugccagacucauaauuuuagaccuuaaauguuagggauggauauggugggaagauguggguugggggggucggggagggugaggcuuuuuuagcauuuacaucagaacuugauugugugguagcagugugcagaacugacugaagacugaaaucagggaaaaagauaggaagcuaguguaccagcaccugccaggguuagagaagugagaauuuuaacuaaaaaaugaaaagauuauugagguccauuugaaauauaucaguauggcacacaaguggcaaggccacuaacuacuaaguaagaaagagaaaaugccaaacuaacagacacaguuaaaauacgagacaugagaauauguauuuuuuuuccaguuaauucagagaauaugucuguagcuauaauuauauaacuuggguuccuuaaauacaacucaacuacuuagagacaguuaccuuuagaguaauuaccuacaguaacuaggaauuauuauaaaaucaggggaaacuuaaaagugacaaacaaguuaacaaguuauaagagaaauaaauuauacauacucaaaaccguggcugcagguccacuuccaauuaagcuuaagggaccaaauucucucaccaacacuaaauauacauguuuaagaacuuagcuucaaugguagaguaucacuguauaaauauuaaauaaaccugaugggcuucuuaccaaauaaguauuauacaaaauccauauauuuccuaugugccaggaaaaaacagaaaaagaaaucccuuacuuugguaacaaaaaggaauugcacacauagacacacacauaugcacuguuucugugaauaaauuuaucaaaaaagugcuauucuauugugaaaauuauaaaaaugagaaaaauaaaaguucugaacaaguguacacaugugaauucuuccaugaauugauaucuuauuaaaugcuauugcaaucugaaccuacaugugauugcuuuuaaacgcaggaauugaauuuuuaaaacauguuaaaguaaucuagaauaauuaagaauagccaaaaaaaaauuuagaacagaaaaacauuaagacuacaauucaacaacgaaaauaccaaaaaacccaauuuaaaaacuggacaaaggacucgaauagacauuucuccuaagaagacaacaaauagcccagaggcacaugcaaagaugcucaacaucacuagucacuagggaaaugcaaaucacaaucgcgcgagauaccacuuuguaccuaaugggaugcuaucaucaaaaaaaaaaaaaaaaaaagcaaaaacaaaaaauuaacaaguguuggcaaggacacggagaaacuggaacccuugugcaaggcuagcgggaauguaacaugguguagccacuguggaaaugguauggugguuccuccaaaaauuaaaccugaaguuaccauauaauccaacaacugcaugucuagguacagauccaaaagaugugaaagcaggccgggggugguggcucgugccuguaaucccagcacuuugggaggccaaggcaggggaucaccggaggccaggccaggaguuugagaccagucuggcgaauauggugaaaccccaucucuacuaaaaauacaaaaaacauuaucugggcaugguggcgggcaccuguaauuccagcuacuugggagggugagguaggagaaucacuugagccuggaagguggagguuacagugagcugagaucaugccacuauacucuggccugggcaagagagcaagacucugucuuuaaaaaaaaaaaaaaaaaaaaagugaaagacuugagcagguaucuguacaaccaucuucacagcagcauuauucacaauagccaaaauguggaagcaacccuacuguucacaggcagaugaacgaauaaacaaaaggugguacagauauaccacggaauacuauucugccuuaaaaaggaaguugacacaugcuacaacauggaugaaccuugaggacacggugcuaagugaaauaagccaguuauaaauaauguaugauucucuuucaugauuacuagaauagucaaaugcauauagacagaacauagaguggugagugccaggggcugaaagagacggagaacuggggguuaguaaaauggauacaggauuucaggggggaaaacaaaguucuggagauggauauggaggauggcugcaaaaaaugugaauguacuuaaugccacagagcuguacauuuaaaaaauuguuaaaauggcacauucugugcaauauauauuuugccacaauuuaaguuaaaaacaaggaacuugugcaacuaguuggaguaagauauuauaaaauaauaaaaguccuacuggaauaaaaccauacugacagauuaauacggugguauauacaucucagagauauaaaaauucaggauaggauaggauaagggagguaucuuaaaucagcaaaaacauacuuauuugugguauuaagauauuugaauugccaaauuaaaauuugagaagcagaacgguacaguaguuaauaguugacaaucucgagguagaucgucuagguucaaacccggcgccaccucacacugccuagugagcagguuccucaccguucugcacuucuguuuucucauaugugagaaugggggugauaggaguacuccuuaccucauagguucuugugagaauuaaaugaauuuauaauuuuaaaaugcuuagaacagcaucuggcacaaaguaccauacaaauauuagcugucagcgcucgccauccaccaaaauaaauuaaauuggauuacaacgcaaagggcuuaagaugaaaccauaaaaaaaauaauuaaacauaggucagucuucuugaguagggaccgucuuauuaugcauaaaaacacaggaaaaguuaaaggaaacaauguauuugacaacauaaaagugaaaaaaaauuaagaaaucaccauaugcaaaauaaaaagacauaaaaacaacaggcaaaggaaaugaacagcagcagaucaaaaaaaaauccuaugcccccaaauauaagugagcgaaagcucuugaugaaacaaugaauacaaagaguugauaacuuuuauuauuauucuuuuauuuaaccucacugugucuaacaccuuuccuggugagccaacugucauuccuaauccccaucaccauugcuuaaccccauagaagaguuuaaaaagucaaauacuugcuuccaaccuuucaugccaguaggggcaagagccagaucuggucuguacccaucagacauaaggacaagagggcgaagggggagcugcugcauggguguccccaugaaaaacaaagagaggaggaggucccugcccugagaugccguccuuugcuuccagccuuugaaugcagucacaggaaguggugggaugcacacggaacuccuagcagccauauuuuaacugaaaagccaaugacaaagccacaugcugaugugagaugaguggagaggcagaaagaggacauuuaugaaucgucaaaccuggaacagccugccucuagcccucccgaggaauaaacacacacagccucugguuuauguccacugguuggguuuucugucgccugcuguaaauuguguucuuaacugcgccauucuccugccaacaguauuggaugcaauugguuccuccuuucuucuugaaaggcuuuccuuacuuggcuucagggaugccccuacguuccuggcuguuccuucuugacucuggagaguccagggagcaccccagagcuauccuugaccugugcucucuacacuuacugccguggggcucucauccagucugguggcuuuaaauauccucuauauggugcugaauccuaaauuuauaucuguagaccagauuucucccacgcacuucaaacuugcauauccaguuuucuacuccacauggccucuuaucaaucauuucuauguaacugaguuucagaucuccccuucccaacaucuguguuuccaccauccauucccaucucagguaaaggcugcaccauucuuccauugcucacaccaacauggucauguucauccgugacuccucccuuugcucucacccccaauccaaucuaagcaaaccucacuggcuuuaccuucaagcacauaccuagaaucugagcgggccucacugccacaaccugguccgagaaaacauaaccuccugcugccaucacagcgacccccgcaagcugaucucccuguuccuacuucacccauauccaaucuacucccaacacaacucucagagugaucccauuaacauuuaagucacuccaguucaaacuccaaguccuaacuaugauuuucaagacuauacaugauccacgcugggcacggugccucacgcccguaaucccagcacuuuggaaggccgagguggguggaucaccugaggucaggagcacaagaccagccugaacaacauggugaaacccugucucuacuaagaauacaaaaacuagcugggcgugguggcaggcaccuacaaucucagcuacucgguaggcugaggcaggagaaucgcuuaaaccagggagguggagguugcagugagccaagaucaugccauugcacuccagccugggcgacacagcaagacugugccucaaaaaaauuaaaaaaaaaaaaacagcagacacugucuccauuauauacauaaacauaugugcaugagaauaugcaaaaagaaaagguaccaaauagucauaaauuuuuaaguuaaaagcuauuugguggugguaagaugacagguguuuauuuucucacuuuuaauuuaaaaugcuauaccuuuaaaauagccuacugggaagagaguaguguaaacuugauaaacuauccaauuugccugguuaaauucaagacacaagagguaaagaauaaaacagggccccgcaucccuuucuugacauugacaagaggcucuaggucagccucuucuuuguugacugccagaaagccaaucuguuguguccuaaucaccuguuggcccuccucuguauuuucacaccaucauuacugacuuugaccucaaucucuacauucuauauucugagccauaacuccucuucucauucuaccuucuaguaucucagucaaguccugaaaaauagcucaauacaugugcauccuccuuacuucucagaucucagggggcaaaaguuaaacagcacaaagcaucaacauuaaaccaagccuggccccuaccuauuuaagaguguaacucuauuacauuauauaaucuccuauauuacagaaagaaaaccauuaagcgaacuuugguauuuguaauuacacccucuuccaaaauccuacaguucuuuuuauuaaauuuuaguauuauaagaacaaaugugaugaaacaagaacuugucaccucuucuauuuggcaguuaauaccaagaaggcaaaaacuacaucuuacucaucccacaaucccucagugucugguacaugacuuaccuagcauacacgcucuaucuguuaaguaaauacguugcagaacacagaauauuucaguaacacucuagauuuauauguugcaaauagugauuuuacuauuccaccuucuugaguucaucaaggcaauaggacucuguauaacuauccucauuugcuuaaauucaaggguaagcuccccagacaaaggcagagcaacacaggugagucauaacaaaaacacggcaagucuuaagacugcaguaauuugacaaaggagcaaaaagucccacaaagggaaguucucacgaugacucgaacuccacagaagcgcagcauucucggugaugcugucaguaccugccucugcaaguauguucacaagaugucuguggcuucagguggggauuaaacaaaaauaacugccuuagucacaggccuggaacaugugucccacaacuacaggaacauuuaaauucagaggggaauaaaccaaagacuuaaagguguugcuucauuuucccagcuaccauacaaaggagauaaacaagggucuucacauguucaccagcaaauuuauuuaccaucugacaccuaugcuaauaaugccugauaagaacaaaagaaggugcacagugagccuccuggcucauuaggagucaagguuuaugagcagagcuccacugagcaaugagguggugagaucauugagaccucaaaacuucacaccaacuuuuuuuuuuuucuuuucuuuucagagggucucgcucugucacccuggcaggagcacaguggugcaaucauagcucacuguagacucaaauuugggcucaagagauccuccugucucaggcucccgaguagcuaguagcugagaccacaggcgggagccacugggccugucucuuauaucuuuaugucagcucuuuucugaugguuuccuuagucucuacauauuuuuacucuuaaaccucaggcaugcacauaccccucugaggugcuucccagucuguagccuccuccaauuucacaugccccgaauuaaacucacuauucuccuccggaaaacuucuugcuacucuauuccacauuucacuucauggcccaccaccuauccagccucugaaggcggcgguuggggagacacuuaggacuguucacaccaacagaaguggccagacacucugucuccuaauuauuuuaaacaugcauucuacuauccguucccaaaaaauauguagcacucgugcaaguuugugucuacauuauuagaacuaaucagccucuaccucccucgaggcagaggcucaucugucauugaccccgggacacgucugcuccaggcaugcugacucuggccuugacguuccccaagcacaugguauccuuugacaaggccacaucugcacccucagcaaccccagcagccuccucugcuggcaagcuccugcaggcgcauuccaaacaguucaaaugucaccgccucuccuccaguucucccucacaacaaguuaguguugcuccuuuacuguggauacacagugcuucgcacaggucuccauucaaaucaagccaaggaauguuuuuaaacaccuguugugcaaccaguacacugugcugggcacuggaaaauaugaaaauaacuaagagcugaacucuauccuuauggauuucaccgucuagaaggagacagacauguaaggaaauaaugagcauacagcacuauaaaugcaaagcagcagagaggccaggacagcugagguggaaucugaagagccaagaguuuucauuggaacgauuugcuuagacacccccuuauccccucacccuccaaccaguaagcuccuuaagagggcauauuugcuuaauccuguuuguagucucagaaucuaguacacugcccaacacagagcagcgacucuaagcacuucuugaaugaaugggcaagccugcacugugacauauuaagccuacucaugagucauuccacaaagcaaucuucuccauaauuacugccaaguaagaauugugugaaacgccuggaaaagaucaagcauuuacaagugaugauguccgugaggaugaaaagaggacaugugccucgcaggcaccugcauggcccugcuugguugguccugaccuccuccgcccauccauguccuccagcccccaccacacacagugcgugguucacuguuccucacgcacccuacacccugccucaccucggggucucugcacggcuggucccugugccuggaaaguccucccgccugacacccaaaugccucccuccucccuuccuuucagguguuugcccaaaugucgcccucucagugaggccuuucuugaccaaccguuuaaaaaucuaaucuccuucacugcuuuauuuuuauuuuauuuuauuuuuugcuuguuuuuuuugagauggggucuugcucucucacccaggcuggagugcaguggugcgaccucagcuagcugcaaccuccaccucccagguucaagagauucuccugccucagccucccaaguagcugagaccacaggcaccggccaccaaacccagcuaauuuuuguauguuuaguagagaugggguuucaccaucuuggccaggcuggucucgaacuucugaccucaagugauccaucugccuuggccacccaaagugcugggauuauaggcgugagccaccauguuuggcucuuucucuuuuauuuuuggauucaucaucaugaauccaaaaauguauuuauuuucuuaauccccuuauuagaauuuaagcucccuaauggaaggaacgggucucuucugugcacuucauuccagcacuuagaagaguucuuagcacaaaccagccuuccccacauucuccuucacacauaugugguuuaaugaagaauucacauauguccaugaaagaagacaggagugugucaagacuucugcaugcacguaaaggaccaggguuaagagcacagacuguggggccagaacacccggcccauuucccgucuccaccaauuaccccacuguguaacuuuggacacguuacugaagcuuucagacccucaaauuccucaucuguagaauggcgauuaucacaguaucccuacuaggaguugugggaauuaaaugagauuaugcauuuaaaagagggcuuagcacugugcuuggcgcacacaggcacucaaaacauguuagugacuaauacuauuuuuaugaaaagagauccugauacacacuuuaaggaaacuaauuuaauuacauaaaaauauagaaacaucuauuagcgacacauuaaaauuaaauuuuauucacauuucagagacagggucuugcccugucaccuagccugaagugcagugguacaauuauagcucacugaacccucaaccacuuggguucagugauccucccaccucagccuccugaguagcaaggaccacaagugugugccacuugcccagcuaauuuuuuaauguuuuguaaagacagggucucacucuguugcccaggugggucucaaucucuugggcucaaguaauccucccacuucauccucccuaauuccugggaucacagaugugagccaccauguccggccucaacuuggcuuuuagaauaacuuauuggguaauaaccucugauuuuuaguaauuacuuuauucaaguaugugaaaaaucucucauaauuuugcuuacugucucccucaaauucucaccuagaaaaguuuaaaaggauauaaaaguaauuugaagaagauuugaaauuaccuuaacacgaaaugaaugaaaaaauaaucaguuuacauaaaccacgaaggaaauaacuuagcaagaaagaagagaaaccugcgaugacaggcaagucacugcaaguuucggacggacuacugucuugaaaggaauuuacuuuauuaacccacaauaaacucaacugaaauaaagaguugcccuuuugaaaugugguuucucuuucucuagaagaaaaccaaaaaccaucucuuucaggaggccuuucuucaccgacccaccccuggacauucuucucauggggccuuuuccccacccaucaccauucuuugugccgcuuuguguuugcugcauaaacacgcacucucccuccucagcucacaggagucacggggcagggagagcauucugcgcuacuucuguaauccuaccuggcucaggcuggccucugaaauggcaacucauguguguagagaagaacacagauauuuaucaucuaaaaccugggaaaagcugguauugccuccaaaagagagugaaggcgggucucucuaaagaugucugaauugaucaugaaggauuuacucagcaguuauuuauucagcagcauuaauuuuauuauuacuguauuuuuuauuguuuuaaguuccgggguacaugugcaggcugugcagguuuguuacauagguaaacaugggccauggugguugacuucaccuaccaaaccaucaccuagguauuaagcccggcaugcauuagcuauuuuuccugaagcagcauuaauuuucaauagccacauaaaaucauucacaucagaguuaacaucaagcuuuaaaccaaggccugaaaagaaaagugccacaguuucuaaaccauucagcugggcaacaagaauuuuaauuuuuaaaaaaauuaaacguuagccugguguggugguucaugccugucaucucgguacugugggaggccuaggugggaggaucacuuaagcccaggaguucaagaccagccugggcaacaaagugagacccccccaucucuacaaaaauauauaaaaaucagcugggcaugcugacacacaucugugauaccagguacaugggacgcugagacaggaggauuucuugaguccaggaauucaaggcugcagugaucuaugguggagucagugcacuccggccuggacgacagagugaaaaugucucaaaaaaacaaacaaacagaaaacaaacaaacaaaaaaacaaauuagacuuuauuauuaaaaauaaaacucaggccaggcgcgguggcucacuccuguaaucccagcacuuugggaggccgaggcggguggaucaccugaggucgggaguuggagaccagccugaccaacauggagaaacccuaucucuauuaaaaaugcaaaauuagccagguguggugguucaugccuguaaucccagcuacucgggaggcugaggcaggagaauugcuugaaccagggaaggggagguuguggugagccacgauugcgucaauugcacuccagccugggcaacaagagugaaacuccaucucauaaauaaauaaauaaauaaauuaauaaaucaaacaaacaaaacucauggccauacuaauaguauugagauuaauaauguguugguuaacagcaucacuggcuggucugaaucccaccucugccacuuuccagcuguuuaacauuggacaaauuauuuaacuuuucuguggaagauuccuugucuauaaaauagggauaagccucaaaguuacugugaggauuaaaugaauuuauagaugaaauuacuaaaacugagccuggaacccgacauauacuuaacagugugagcugcuaucauugacauuauaauaauuacuacuacaaauaauuuucaucacuaucucaucuuauuucaguauauuuccaaagaagcaaagguaguuuagauuugguuuguuauaaucucuuauaaucuggucucauauaauauauuuccacauuuugacaaguaaaauggaacagcucuuugggaggccaagguggguggaucaccugaggucagaaguucgagaccggccuggccaacauggugaaacccugucucuacuaaaaauacaaaaaauuaguugggcgugguggugggugccuguaaaucccagcuacucaggaggcugaggcagcagaaucgcuugaacccaggaggcggagguugcagugauccgagauugcaccauugcacuccagccugaucaacagagcgagacuccgucucaaaaaaaaaaaaggaaaagaaaaaggaaaaagaacagcuguguuggguuuaauuacaauuccuucucacauucauuuuaaagcuucaagaaaauggcuguuucaauacugggucugguuuucuacuuaaguguucugaaaggauuuauugaaaacgccaaauuggcuggaacauuucugccgcuuaccuuucagcagaguaacugugagucaguaugguggauauccauuugguuucaauuugcuaauacacacagacacuucauuguacaaucaauggcaacaggaucacggggaucuaaaagcacauuguuucugcuccuugauuuuucuguucuacuuuuaacucuguggcgauuaagaaacaccucucaauuuacugagagcauccaaaaaaauuaguugcuauuaauuuuucuguaaaacauaauacaguagaaucaaauuagucuucuuagucggcucaggcugccauaauaguaauaauaccagaugggguggcuuaaacaacagaaauuuguuuucucacaguucugaaggcuggaauguccaagauagaggugccagcugaucugcuucccagcaagggcccucuuccuggcauccagauggccacauucucauucuaccucacauacugaggacaguuccagugucucuuccucuuuucuuuuuugaaagagaguuucgcucuugcuacccaggcuggggugcaauggugcuaucucggcucacugcaaccuccgccuccugggaucaaggaauucuccugccucacccuccccaauagcugggauuacagucaccugccaccacccuuggcuaauuuuuuuuuuguauuuuuaguagagaagggguuuccccacauucccacauuggccaggcuggucucaaacuccugaccucaggugauccaccugccucagccucccaaagugcugggauuacaagcgugagccaccaugccaagcccaucucuucaucuuuuucuaagggcaccaccccuacuggauuaggaucccacucuuaugaccccguuuaaccuucaucaccuccucaccagcccugucuccaaacacaaucacauugcagguuggggcuucaacauauuaauguagagggacccaaguauucagaccauaaaagucuucuaaccagucaaauacaaaacucaaauucaaauccagaauguuuccaguuacauuaacuuuguuuccauucagauacagaaaaccacccaguaaaacguaauuaguuuuuaacucagacugaaaaaucuggaugcauaacucaguuaucaagcucaucgacacaggaugauaaaagcucaaaagcaugcccugucuuuucacuaagacuaaacagauccacuuuucucuaagacacauuaugcaacacagaguaaaaggacuuaacaacuacuuccccgcugggugggacugaucgccuacauaaaaggauucuaucuuuuucaauguauccuggguacuggccucauuucuuaaaaguaugugcgcuuagauuuucugggauucaagccccacgaaauucagagaaucauaccaguaacagcaguuacucagaaaauuaggugagcuccaaauugucccuagaaagguaagggcuguaaaagcugacagggucuuagauucucagacacuuacacuuucaagaugugaagaugaagcccagggagaguaaaagacuugcucaggcagcguauuggggccagaguggaacuaaaacacagggcuccuaacugcaggccaggggccacacuccagugccaccaagcuacagguguuccucacagaggaggaagggagcuucccauucucugcaagcaccaugagccuuauuggacaacuacaguaaggaccagagcuuuuucuucaccaccaagggacaggguuuugcucugcugcccagguuggaguacaguggcaugaucauagcucacugcagcuuugaacuucugggcucaagugaucuuccugccucagccuccugaauagcugaggagccccuacaagggcacaccaucaugcucucaugcccagcuguuuuuuuuuuuuguuguuguuguuuuuuuuuuuuuuuuuuuuagagauagugucuugcuauguugcccaggcugguccugaacuccuggcccacuuuggcuuccuaaagcacugggauuucaggcauaaaccaccacacccagccaggacuagagcuuucaucucacucaugccuugacuccccagguguggcaauaucccaaauaagaaucacucuuucucccaauggcuuuuggccucuguuuuucucccagaugaugaacacuccaagcuaaugaauuccuguuuccacccagauccucuggggauggagccaugugcugcaaaccccucuuccuccacucacgccucuguggucaugucuccuugaccuugacacuaggccugaaucuaaauaaacagcccguaaaacauuucuaagcauuacaggcuuucacacuugaggcuucaugguaggguugaaaaaugaaaccuacaaauacuaaauuguagagagguacagagaucuucugggauuugcucgcuuucauuaguuuccauaaaacauucucacguguguggacacauaacuauuuguauaagggaacuuacuacuaaauugauuugacaugacuuuaauuugcccaaggcuguaccggcagaaguaagguggguucuuugcaagauguucucagucaauuggaauggcuagcaggcuuuucauccccgugacacagggaugacuuuuccauuucuuuguaacacagaucuguacguccgccaaauuuaguaugauacuuaauagcuauucuugaggcgcucacauuucauuggccuaacaugacuuuaaaauuacaaauuguaagauacaagccaacauaaauaaaaguucacauuagaaaaauuuaacuuuuuagucacccucauaucccuccuaaaucuaucauacaucuuucaguaaaauuaaaaaaaaaauuaaucucuucacauguauugagggcacacuagggaccuaccguacaacacuucagcauuguuaagcacuuaaccauuugaaaaaacuuaaugaaaugauucaaauuuacaucagccacccaauuguauauuuauguacacauccuucugaauagcuuauaagaugguuuauacaccuauaccucucuccucaacuagccuuugccuugcucaaagauaagggauauauguugucaucuucuuuuucuaccuccugugcucaggaugcugauccacaaaaggcuaacugcuuuagugacagaaggcauuagaccuauaaucaugacuguccaauuuuacauucaauuaacucauaaacuauugaacuauuuuauucuuaccagaacuggacacacgccugauccucugaggagauacggcucgaucagcacugggauuucuauugucacuguuccgccucaaacaggaaacagggggccccacuuuggcuuuuggagcagcuauuugccucaaaccgcaggagucaggcuuggauauauuccuaccugagguggucguuguuuuugaagcagagcccugugaaaauaacaguuaagacuguaaaccaaaacuaaaauucuaagccccccaacugacugaaugggccccuccucuaggccaaggcaauuccaaagaaaccuaaaaaacaaguucaggccaugauggcaaagaggucagacaugccucauuauacucuccucccuuuagaauucaggcacaacugaccagaauuaacauuaaaacagaaaccuuaagucagacaaaacagacucuuuauagcaaaaagacacuaaauuccaaccugacucuaguuuagcaucacaugacagacagcaagcccugaaggaaauugaaguauuuuaccccaaaauauuuuucuuuaacacauuuugaaauggcccugcaaagcugucucuuguaggggcaaauuuacauucuguagagaaucuucuucccuucccagaucuuuggucccaaagaaauuagcugagagucuagcaccuuuuaaaagucuaaauagguaauauuugccaucuauuaccucuaaaggcggccacguaugagauuucaucuacauaauaagaaccuuggucuccacagccccuuaucuuaucuuaaccgagacacuccuuucuauugauuucaggucuuuagauaauaacuucuuuaguuuuuugacacggagucuccucuaucgcccaggcuggaguguaguggcaugaucccagcucagugcaaccucugccucccggguucaagugauucuccugccucagccuccugaguagcugggauuacgggugcacaccaccaucaaucuuuuuacuuuuaguagagauggcuaauuuuuauauuuuuguagcuaaguuuuguauuuuuuuuuuggcauuuuauuuuuaguggagaugggguuucaccauguuuucuuuuuuuuuuuuuuuuuuuugauuuuuuguauuuuuaguagagaugagguuucgccauguuggucaggcuggucucaaacuccacacuucgugaucugccgccucggccucccaaagggcugggauuacaggcgugagccaauaacuuaauucuuucaacgaacugccaagcaguaaaucuuugaauccaccuaugaucuguaagucccuacuucaagaugucucaucuucccagaccaaacuaacguguaucucaaauguauugacugauguccucugucucccuaaaauggaugaaaucaagcuguaacccaaacaccuaggcacauguucugaggaccucuugaggaugugucaucagccaugguccucauauuugggucagaauaagucucuucaaaugauuuagaguuuggcuuuuuucauuaacaaaauuuuaauccagaucauaccuuccccauaccacuuccuugugguauuagcuacgugaaaggaacaauuucuaagugaacguguacaguugucccucgguaucaaaaaugauuaguuccaggacccuggcagauaucaaaauccauggacacucaaaucucuuauaugaaaugguguaggguuugcauauaaccuauguacauccucccauauacuguaaaucaucuccacgaucauuacuuacaacaucuaccuauuacuuguuucagguggauucaacauaguauucagcauguaguaaguucaaguuuugcuuuuugaaacacugcagauuuuuuuucugaauauuuucaguccaaguuuggcucaauccacagauguggagcccauagauacagagggcugacuguauucaauuuucauuuuuacuaugaaacaauuaaaacucuucacagcuuacucuuuaauucaccauauucugccuuuguacccauuagugagaguguacucaagaucaccagugucacaaguuaaauucaagcuaguuuucaauccuuccccugggggcucucucuacacaucgaacguuaauaacuccauucucugguuuccugacaaagcucuuuccugguuuuccuucuaccuguccgguuauuccuuuucuggguccuauucuucuguaccuuuggaagcuagugauauaauuuggaucuguguccccacccaaaucucacaucgaauuguaauccccagugcuggaggagggaccuggugggagguaacuggaucauagaagcagacuucccccuugcuguucuuaugacagugaguucuuacaagaucugguuguuuaaaagggugugucaccugcccccucacucucuuccuccuccuccagucauacaagacauugcagccuugcuuccuguacagccuguggaacugugagucaauuaaaccucuuuucuuuauaaauuacccagucucagguaguucuuuauauagcaaugugagaacagacugauacagcuagucuucaugaagaccuagccuuggcccuguucucuuuccucaccauguacucuuccuacaugaucuuggcugcuguuucaauugccacguguacacugguacauccaaauccacauguucaaccaguacucucuccugaguuucccauauaccuaacuucuuucuauacaucccaacucagcauccuucaagcaccucuacguauuaguccauuuucacaacgcugauaaagucacaccugagacuggguaauuuauaaagaaaaagcaguuuaaugggcucagaguuccacguggcuagggaggcuucacaaucauggcagaaggugaaagguucaucuuacaaggcagcagacaagagagaauaaaagccaagggaaagcaguuuccccuuauaaaaccaucagaucucaugagacuuacucacuaccacaagaacaguaugggggaaaccacccccaugaugcaauuaucucccaccaggucccucccacaauaugugggaauuacaggagcuacaauucaagaugagauuuggguggggacacagccaaaccauaugacucuacuuaacuuacuaacauauagcccguauagaauacuauucuaaauucuaaguauauguaucaauucacuuaacccucauaauaauccugugaaguugguagguuuauuguaccccauuuuaaagaacaagaacaugaagcauuuucuaaaauuaaucuuacuuuccuaucuaucucaaaacuuaucucuuccuguauucaccacaacauacccaggcacccaacuucaacaaugaaagcuguuucucuuuuccaucugcugucauuucucagcaagauuacugaaacgauguccacaggaucuuucuggucucuccagcuuucaauucaucuuuuaucugccugcuagggcaaucucucucaaacucgaauaggguuagacaccuucugucugucuuccagauaacaucuucuucacaaggcccagcaauccuuuugcauauggaagccccugccauccucuucaccuuauucccuacugcucaggguuccauucucccagcucccaccacaccuaccuagaguccccuaaauuagaaaaucuucucauauuucuucagcuuuguacucuacccagaauaccugcccuucaaauuccagcuagugacaacaugugauguccccuauaagccuuccuugacaacucugcccaccaccacaucuuguucccccuccugcagcacagcagucuacucacacucccaacuuagcaaucaacauacccuugccuguuuacuguauugauagaggcaggaggcagagaaauucuaggcagacgggggcagguccccagcaaaaccccaccuucaaggcaaaaacccugaaacccacagccuaaagugagaacuucuaaaccuguuugcccacucucuccuaauuaguucuuucugaauaaugucuuuuuaccaauugaaaguugccuuuuccaaaacuaccuauggccugccuugccccccacaucccauucauguaaagaccccagacucacuugguaggggagacaagcggcuugacugauguauuaguccauuuuuacgcugcuuauaaagacguacaugagacugggcaacuuacaaaagaaagagguuuaauuggacuuaagaguuccacguggcuggggaagccucacaaucauggcagagggcaaggaggagcaagacaugucuuacauggauggcagcaggcaaagagagcucaugcaagaaaacucucccuuauaauaaccaucagaucuugugagacuuaaucacuauuaugagaacagcauggcaaagaccugcccccccauuauucaauucccucccacuggguccuucccacaacaugugggaacucaauacaagauuuggguggggacacagccaaaucauaucaacuggagacuucagaggacagcugagucuacugucauaucacccugaacacacccaaucucgccugaucuuugaagcuaagcagggucaggccugguuaguacuuggauggcagacagacagcuggacuuuggaggagagauggcuuagcuuuggagaagagccaaguguagauggccagacuuuagggaagauuaucugcccguccugucccgucuucagcuacccucucugcugagagccacuuucauugcuaaauaaaauuaucugccuccaccauccuucagguguccaugugacccaauucuucuuggacaguggacaagagcuugggacccaccaacuuuggguacccaaaaaagguuaucacacugacccuuugcccucgcuacuggagggcagcugccccacacagugaggcaaagggcccacugagcugaugacacaccgguguccauggaugguggagccaagagagcacuguagcaugcccucuggggcuuuagggucacagacaccaccaccugggcaccacuguggggccugcacacagcaugcuccugccggugcucaaaguggcuggcuggauccuguacucacuugcccacacacuccugcccgcaagagguugagcauggcgggcugaauggggcacccccaucgcaaguuuuacaaauggguugagaaaaacuccugcaacaguauuacccacugcacuaggcacucagacagggucucuuuuuucccuacauccuaacaaucaucaccauauguauaauacauaguaugcacccaauaaauguuucuauucuacauagaggaaaugggagucugagccuuacucacagugugaauuccaacaccaaacuacaauuugcaauucucccuuuacauuaauguaaagcaaaaauaaaauucuaagccccccaaccaucugaagggaccacuucucucggccaagggcauuccaagguuaaccugaaaaacuaguucaggauaugaaaggaagggggagucagacauaauuauacucuccgaaggguuggaauucaggcacagcugaccagcauuaacaucaacaaagaccuuaagacugauagaacagacucuuuuaagucugauaagcaacauuuacaaucaacucccccugaagccggcuaccugaagguuucaucuguaugauaaaaccuugguuuccacagcuccuuaucuuaacccagacauuccuuuuuguugauuccaggucuuuaacucuuugaaccaacugccaauuagaaaaucuuuaggcugggggugguggcucaaaccuguaaucccagcacuuugagaagccgaggugggcagaucacaugaggccaggaguucgagaccggccuggccaacaugaggaaagccagucucuacuaaaaauacaaaaaaauuagcuggguguggugguccucaccuguaaucccagcuacucaaaaggcugaggcaagagaaucacuugaacccgggaggcagaggcugcagugagccgagagaucacaccacugcacccccagccugggcaacagagaaucugucucaaaaaaaaaaaaaaaaaaagaaagaaaaagaaagaaaaucuuuaaaucugccugugaccuggaagcugccuccacuuccaguugucucuccuuucuagacagaaccacuguauaccuuacauguacugauugacgucuuaugucucccuaaaauguguaaaagcaagcuguaccucgaucaccuuaggcccaucuucucaggaucuccuaagggcugugucaugggccacuggucacucauguuuggcucagaauaaaucucuucaaauauauuacagaguuugacccuuuuuuugacacaaagaacaacugagcucaauagagacuuaguaaccugccagaggucacuuugcccaguaaaugguggagcuacaauuugaaacuacucuaaaauccgugcuuguaaagcagcauguucccugucaucacucuucuuucuuuaauaaaucucaaguguuaauuuccgauagauacacauaaagcccaaugccgauggcagucgaauucauacauuaggugaauucaacaauaacuuagcaggccaaucacccaugagaacagcuggaggucauguuuuggcacuggagaacaauacagaauuggccaagaaaagcaagugacuguacacaaacuaacaaagaucuucugucucuggcuagguuaaauuaaagcuggcuaaauucaucucccagagaaaaaucuucuuuuaaaaagcaacccaaaaguuaaccucccagagaaaaccuucuuuuaaaaaguaaggcaaacugcucaucaauuuacaaaagugaaucuucagcaaaucacuuguuuugccuuucagagccaacauuccaaaaauuuugaaaccguaugguguauggagcagaaaaggccaggauucaagugagggcucugagugugaaucccaauuuuacuauuuaccagcugugugaguuuuaagugaccucgcugaaguauuaaaaugucgacaacaauugcccuguuguuauugggaagaguaaauaacaauguauggaaagcaccugagcguuacagggcccauuaaauggcauaauauaacuaaggcaccugagcaaagugccugacccagagcaagcacugaauaaauaucaauuccuuuccuuuuagguuaagucuccacucccuuuaucucacacacuaucaugaacacauaaccucuguugugaggagcuacaucuagccccguuucaaauaaaaaucaaguuccuucuuccaaauaagaacuuuucuaaagauucagauacacccugaccaccaaugagcugugagguugcaggcagucuagggauucaguaaacucaaggccuaaggcaggccaaggccaacaaagcaacaguaaaaauuaacauccgaccgggcgcgauggcucacgccuguaaucccagcacuuugggaggccaaugugggcggaucacuugaggucaggaguucgagaccagccuggccaacguggugaaaccccaucucuaauaaaaauacaaaaaauuagccaggcaugugcaccuguagucccagcuacuugggagaaaugcgugaaccugggaggcagagguugcagugagccgagaucgcgccacugcacuccauccugggugagagaggagacuccaucucaaagaaaaagaaaauuaacaucccuccagcauggucucuucgucaauccagggcaguaagagccuuugagugcugcugaagugaccaaccgacauucauguuucaggaaaacacgcagcaaauucauucagcucucuacaguaagugcaaagccaguggccuaugagggucugcccagacacuuuccaguccuccuucccagagacauggaaaugugcaagagguaaacuagcaaaauuagagagcacugugcuucagacaugaucgugaaaaaagaguaggccgggggcaguggcucacgccuguauucccagcacuuugggaggccgaggcagguggaucaugaggucaagagaucaagaccauccuggacaauauggugaaaccucgucucuacuaaaaauacaaaaauuagcuggaugugguggugcacgccuguagucccagcuaccugggaggcugaggcaggagaauugcuugaaccugggaggcggagguugcagugagccgagaucuugccacugcacuccagccuggcgaaagagcaagaacaagacucugccuuaaaaaaaaaaaaaaaaaaaaaaaagaaagcaaaaaagaaaaaagagucccuuaugccaguugauaagcauaugcgaauaugggacaaucuuucaagacuuacaaaguauuucauaucuaauuaugaauccuaacagccagauuccugaggcgaaaagugcuguuucuccaagacauacuaggauccauuucaaccugaugauucuauccuuaccucaguaccacaucgggagccugaaaaacagguuuucaagcugcacaggggcaacauaacccuaagacucaaugcacaaaucaggaaaacuuuuaguuucaaaauuacacaaccaauuuaaauucaagacaaaugucauuaaagaaaaagaaacuuuaugauagaguuuuugguagcuggggacugacacaccaaaaaaagucucccauaaaucaagagaauaaacaucguguuucuauguauaucuguaaaugccaaacuaagaauguugauuagaauuaagaguauguuguaauuuaauuuugcaaaaaaauuaaaauuauaaaugauaucgguuuucuaaguuugacuucaagauaacuuaaaaacuaaaucugaguuuugaaacaacggaugaacucauuaguuuagaaaucacugugguguacccuucuuccaaauagagaagacugguuguuaaagcccaaacaugucuaaacugauguuuuagagaaucuagaauaucuucggucuuuccuaaccuugucuucuaaacggaccugacaauucccucccuugugguccccaugcacccugaagacacaccuaagucagcccuucugcacuugcuauucuaugugcuucauuccucuugccacgagcccuccaagggacaggcugucugugucacaccugccuuucuccgcuggcacuuagcucccuuccuggcccagaggacaggcacccaaggacagccugucuggggcugaaaauacaccuaaguccccacugccaaaaauagggcugaggacacaugcccaacgaccaacaguggccugucaaauguuuuuaaaacccagaaaaccaauuucuacacacuauucucaaaaacacaugcauguuuaaaggaaaaucaccuuuacacugcaugugaauucuuuauucuuuaaacagcacucucuaggucccccccaaauauuuuagacaggcgcuauggaaaacauacugguuuuucacuauacauaaguaaaagauuuuauuuuauauaccaggaauuaauauauuaaggcugcaagaggcuucacacauccacuagguccaauccuuucaucuuugggucucgaaaaauuacuugccaaaaaucauuauuggccggucagaggaaaaaucaagaacacucuugcucauacaagagggcucuacuucccagagcugccuccuccgcaagaguccaggaguuauuuuuauguugacauguuuaccagcacucccaagcccuuucuuaaaugcuguccaauacauuuuaaaguugacaacccaacuuuuucagaaaaauaaaauauaaccugauuguaucaggcacuuaaacuacuaauuauacuaaaauauuaaaguaacuucauuuuucagcacacuauuaaaaggaacggugauacuugauacaaaauacugaaauugaggauuuuuuuuuccauaugcaguuuuguuguauugaaaccuauuaacaccccaguacugacaagacaaugaauuaacaacuaaauguaaaucugcccaccugguucugcaauauuauugacuaauagauaacuaaaugcuaacacaucucaguuuucuccacaguucucugaagcaugcaaaaaauauauauauauuacuuaccaaaaacagagaaccauauucaaaagucucauucauaaucucuuguuucagcucuuguuuuuccauagaugucccauuuucuuuuucacccuucuuuucagggcuaauccuaucaauguugggaacauaggucauuuccaaacauucugcacuuuccauuuuaacagggaguaugccuuugaucuucugaaacaacgcagaaacggacccggucucgcaugcugaguuagaagaacuggcuuugucaacaucuuccugauucgauuucacggcagauguuguucuuggaacccugugugaagcauuuuuagaaugaguuguaacaugcacagccuggcuaguaaugaguuuauuaaacugcugcuuaugugucuuguuaauuagaauuucugcuuuuuugucugcauucaagucagaucucgguguucugcucaagacuguuuguugucuugaauucacugaugagggugaugaggcacuggucugcugaggucugggcgugaccuuugauaaagcagcaucuuugggcugcaacacugcucuagacauaacuuuugcuuugacauucuugaaguuuggucuuggguaacuuauaauuucaguuuuucuaacuuugcagccuauugggguauucguuuugauuguugauuuuccuaaacuggguuuacacagguucacaggugccuccuucgagucugguauguuuuuaagcccucgauuacccuucuccacuuucuuacauuucuccgucgcuucaaucggugaaacagaaaagguuacuuuuguggguucuaggacugguguugacaugcacaucguuuugucugugcuaaugaccauaucauuugcaucccaagucaguccaaaugacgagcccaccuuuuguccuggcgggcuacuuagaaucaauucugagguaugauuuuggguucccaaauccuuuccuuuggagaccauuugugugucuucagucucagugacuuuaugcucuggguucagcacuugagcuucgcucuuaucaaaagcuggcaccauuaaagggcauucaucaucaauaagacaauaggacacugucucucucagauuuuggcccauuuccuugugccuguaugagcucugugaaugugguucgcuauuggauucaucaugggauaaacaaaagaacucuuguaaugcagaaucauuggggacuuccaugccaucagaaacugguguuagugcuugugucuccuuuucuccaacuagucuuuguugugauccaucuguguacucacuggugaccuuuccugaagaacaugcacacugauuuccaauaucugaaacaaaaaccucacuuugcaucaccacaucagaaaaugcuguguaagucaugucuugggcuucugauggugugacuugaggguuuucaaagcuuucucuaucauaaguaguuucucuugcaugcgucuuaucagaaugggaagauguccaaguggaauaggauaaagaagauguacuuccacuucuccuaccaguugguggcaggcuuccagcaguauggaaggacugacucuuuccgauggcaugaugugauauaaaggugcaguuaacuuuauccacugucaugucaaauguuugguuuagcuccaaggcaucacaguagccugcacaguucaaauugucauuaggcuuccacacaaaaggcaaagauggcucaacacucuggcccucaacugcuucuagggaaugacaacuguguugcagauauuugggcuucucaguaccuacaagugcaggacacugacaaauagaaucuuuaugcauaucuaacaccugcuuacuaaugaaaucacuagaagacuuuucaugaccaaauacuucaacacccugaaggcuuaaagaaauauuuucaccaguaacuacagcagggucaguuucauaaucaaccaccaugucaucuggguuggcagaauuccaguucacacugcuggcugaagaguuuuguguagguggugauuucggguuguaugcauguguauuuccaucuuuaucacugguaaagaagguuugcaauucaucuucuauuuuaucaucugaauuaucaucagucauccugaauaguaaccuuaaaccucugccauuuuauuucuucuucaauuccuuuuaaaugagagggugggcaaaauggucugucuucuagguuuuucagcacaguugaaagguuuucagucuaagaugcucugaagauuaaaugauuuguuguucccuggaagaaauaaaauguuuaacucaaguaacuauaagaaaaauuaacaggccaccccuugguuucaaucacuaagugauuaguuucaaucacuuuauguucacauuuagaccccacaacuacugauguggguaacugagauauaaucaggcaaucuaucaccgcuuuucaagauacuuuuuuaauuugagggaauagcaaauggggcaaaauggaagauggggucauugcucguuaacccugucccugacuuuauaacugauaugccucucccccacucccagggacuugucaaagagaggaggagguaaaucuggcaauaguauuuucuucuuguuggcugacagagugacaauucacccaaauuugcuuaugacagucccaaaguaugucuguugucccaggaugauuaguaaacaugucccuuucauucucagaagggccccccuauuauuuccaugcagagugauuauuagacaggccaugaaagcccagcaaaucagcugaagaucaaucaagaacucacguuucuccuuuguuuuuauuccuaucuuaaacauaugcuauuuccaaauugaaggggaaaaaaaaauugucgauucuuaaaggcuccagugguacccuguuggaagucccuugaaaugugaguuaccuuauguuauacacuaaacuguuccccaccccucuccaauucauaugucaagcccaaacccccaccccuuauguaacuauguuggagacagagccuuuaaggaggugauuaagguuaaaagcagucauaagcguggagugcugauccaacagagcuggugcccuuagaagaagggaaagugacaccagaaugcucucccacucuugguucauccccucucucuaccaaauuaggguacacugagaagaguaggagagcucucaccaaaaaccaaacccugaaaagaaccuuaaucuucaacuuuccagccuccaaaacugugagaaaguaaguuuuuguuguuuaagccauccaguguaugauaauuuguuaugguggccgaagaagacuuaaguaccacaugccccagcaauucuacuccuaagaaucuacugaagaaaaugaaaacauaugucaacaugggaacuugcacacaaauguacaugauucuaaauagaagcacuauucauaauagucauaaaguagaaacccacaugcccaucaacugaagagcagaaagcaaaauguacucuuaugcauuugacaaaauauuccucagcaauagaaaggaaugcaauauugacacaugguacaacacggauauaauauuacacuugaaauauuauaucaaaugaaagaagccagucaugaaagucuacauacuauaugacacuauuuacaugaaauguccagaauaagaaaaccuaaaguggcugcuaauugggaugacguuucuuuugcgaguauguucuaaaacuauguacugaugauggcugcacaauguuauauacugaaaacuacugaauuguacacuuaaaaaugaaaccauuaaaacacccacgaaagcauuuaaaucuaaaacuuuuugcaaauaaauuauuauugcuuuuuugagauggagucuugcucugccacccaggcuggagugcagugaugcaaucucggcucacugcaaccuccaccucccgguuucaggcaaucuuccugccucagccuccugaguagcagggacuacagguguacaccuucaugcguggcugauuuuuguauuuuuaguagagacaggguuucaccacacuggccaggcuggucucgaacuccugaccucagguaaucugcccaccucggccucccaaagcacugggauuacaggcaugagccaccacgcccggccacuuuugggaaauaacuuaaauuuuauuaugcuuuuggucaaacugcagugccaaagaaagguccaaauguucaagcuaggacugcaaacaggucauugugaauccuaaaaugagggcugugugauuuauauucugauggaaaguguaaauuuguuaacucuuuuuacuacugcaaacagauacgcacacacuugaacuaauuuucuaauccuaguauucaaugucaauccgaugucacaguacuguuguaaagaaaaaaaaauauccaugagggagggaaaaaaugccauuucguguguuaauucaacuugccgaaugaagaguaggucucauuuuucuaucuugcagcguuuucucugcauucaaacuucaguggccugaauaaaaccagaauaggaacuauguuaaaacugaaacgaucaguuuucuucgcuaacagugcucugugucuuucuggccaagcauccugauaccagccuuuaauggaauaaagaaaggcugcaauguugauuucaacagcaugugcacacauacacauccaaaaagcgauuuugaauccaaaaaugaaggcugcgugauuuauauacugauggaaaguguaaauuugugaacccuuuuuaccauauaacuccuuagugaaaucacugaauaguuuauuggcaagagccuuaauaaaagcuuuuaugaaacauaaauuaacauuuuuaauccuccaguauaaaauacauccaagcuaaauguuuaaaucaagaaauauauuuauucauuuuuaggcuuacaugcaggggauauaauuuccaaaagcacuaaauaugcuacagcuuucugcuucccuaacagcuaauacucaguuaacagacuguggcauaagcaaauauaugcaaagugcacugcaaacacgcacuuagcauagaucgugggaacugucuuuguaaauaauuguuagcuucaauuaauggcauuuuuauuacucaaguuuccucuucugaagugcauaaaagaugauuuuuaaaccucauauaaauugaauuaagggcucauaugucaaaguuauuuuuuauuuauuuauuuugagacggagucuggcacugucgcccgggcuggagugcaguggcgcgaucucggcucacugcaacguccgccucccggguucaagcgauuacccugccucagccucccgaguagcugggauuacaggcgcccgccaccaugcccggcucauuuucuguauuuuuaguagagaugguguuccacuguguuagccagcauggucuugaucuccugaccucgugauccgcccgccucggccucccaaagugcugggauuacaggcaugagccaccaugcccggccccaagguuauuuuuuaaauaaguauguaagaggauaaauaauuuuaucacuaguccuauguuuguuuuuaccaguugucuuuuuuuauuuuucuuuuuuuugagacaaggucucacuuugucacccaagcugcagugcagugaugugauuacagcuuacugcagccucaaccuccuaggcucaagcgaucuucccaccucagccucccgaguagcugugacuacagguaugugccagcaugcccagcuaauuuuuuuaaaaaacuuuuuguagaaaagggguccagcuuuucucauuuauaaauaauacuaaacugaaaucuucacaaucuuugacaucugaucauuugccaaauugcuauauuuaaaaagggggcaggauucuuuauaaugugcauguuacuauauauguauauuuuauauauauauauaaaaguucucuuucuuuuuauauauuuauauauaaaaauacguaauauaaaauauauauauuauauacugaguuuugcuuuuaagacucauauacuguggucagcauugucucugaagcauuuucccaugucauuauacuauaaaaacauuuuuaacgguugugaaacgccacuaaaguuaagguuaaauguuuuagauuuacaagcuagugguuuacaagaguaacagaaaaauaaagaagccaucaaccauuuaacuuucacuuaacauuuuaguacacuuggguuuaugauuuuuuuuuaauucacaaaaagagauuggguguggucgcucaugccuguaaucucagcacuuugggaggcugaggcaggagcaucauuugagcccaggaguucaagacuagccugggcaacauagcaggacccuaccucuacgauuucuuuucuuuuuuuuuuuuuuuuuagcacgguggugcaugccuguagucccagcugcucagaaggcuagggagaaaggaucaccugggcccaguaguucacagcugcaguaagcuaugaucaugccaccacacuucagccugggugacagggacccuaucacuauuaaaagaaaacaaaacaaaauaaaacaaauuucaaauuggugagcaaagagacuaaaaaacccacaaacauguguucauaaauacuuaaggauuguuuuuauauaaaauaaauuuacugacaucucuucuacuuuguagacaagaguaaaaaaauagugguacagggauuuggauaucaaaaagguucugcaguuaagcugaucaguuccagcaagauggaagaucaaccucaccauucaugaaaagaaaacaauggcuuuaagucaccaccaccaccaccaugaagacaaagccaaggacagaaaaggggugaccggccuucgcucaggaguuugucaaaagaguuaaaaguuggccauuuuguuuuacugccuauuuuauuucuccccgacuuuaagaauggguccuaagcuugcaccacuugcucgacauauauauucuuugccuucaucucaccugacucauaagcaaagucuucauauugcuguaguugcuauuuguaaagccuucaaaguugccaucuuagaaauauuuugauuaaacaagaugcagaaaguuaaaaaauaaaaagacagagagugugcuggagggaaaaaaaaaaaaaaaacuugaaacaaaccauccucacccaaagggauaauuucucaaguucucuuuugguaguacuaccuaccagaacaaagguauaacaccagaacaagguauaacaccagaacaaagguauaacacuuguguaacacuccagaacaaagcagaaugaucaaguuuccuuucuaagagaaucauuugggaaaacaaggagaucuuuuucagagaacauuuuggaccagagagaacaaauuccccacuuauuaaagagcugggaauguaacagagcagcuccucuuaaacgguuaccaaaauauauauuucccuaaggauuuauaaggauuaaaaauuaguaaauaugugcugaaagaaauggucaaagaacuacuaguacaagcuuugagguauaauuccaaugccuuuggaaaaaaaacuuucuaaaucuuagcuuaagaaaagugauuguuuauuccccaaagauaaaaaauuccauuauuucuucaugugaagagacacaccuaaagaacugaaucauuauauuaauuacaauuauuaucauauaauagaauucaucaucauuaccauauuaaugcuagaagaaauuuuaaagauccaauucaaacuucauuuuacaaaugagaaaccucugagaaaucaacugcaugacgugaccaaaucaguugucaauagcagauuauacaauagcugugugccuuauuucaccaacugaacuagaaacucaauagaggcuuauauaagaguagaugucuucuauaucucccuauuacccacagugucuagcuuaauaauuuggaccuaauauaguuaaccuuguaacaccauauuauaacuauaaaaucaagaauguuuccaaaaguaaaacauaagaacuggcuucauuacuuuauaaccacacagaauguaauuuuacuacuuauuuauguuaauauauggcacgccaguccuuuaagaugugaauacaaauacaguuauaauuuauagcuuccaaaucauaaagccauuaucagucuucuuaaaaguuuuuaagaacucacaaaucacaauaguaguuuagcucuguaagcuuuaaaacccaaaauauuaccugaucuucaaccucccuugaaucaaaaaagaugacauuggcacaacaucuaagcuaucauuuuaucuuacuaaaaacgaagcaguugaggccuggugcaguggcucaggccuauaauaccaagacuuugggaagccgaggugggcggaucacuugaggccaggaguuugagaccagccuagccaacauggugaaaccccgucucuacuaaaaauacaaaaauugccagguaugguggcaggugccuguaaucccaccuacucaggaggcugaggcaggagaaucacuggaacucaggaggcggaggucgcagugagccgagaucacaccaccacacuccagcccaggugacagagcaagacuuugucucaaaaacaaaacaaaacaaaaacaaaaauuaagcagcugaacaaaaugucaucagcagcauguauuauaaaaaauauauucauaagacuccaccuccuguuaaaaccauucaagguagcuaacaguucuacucuaagccucaacuuccuacuauuuuucauaaugcaagcuuacauucuuaaauuugcucuugcagccuaccuuucaucaaacuuaauagccaccucaagcacuacguuuaacggagcaugucuaccaccuaggaaccgaguagaggaguacuugguggucaauuuccuaaaagcauaacgauuuccuaugaaguugcuuaaaucaacagcaggaaacuagaguugauuuaaugcauuucaaaaugguggacggcuaugaaguaauacaaguuauaccuuaaauaauuuagaaaacaaguauaaauuugaaauuacauccuuuuauucugaaacaguauuucucugacuuuaaugugcccacaaaucaacugggccuuugguuggucaacugacugauucagaaggcaaggauggggccugagauucugcauuucuauccuucucccuggugauaccaauccuuuugguccaugggccaccuuggauuagcaaagaugcggcaaagagcuuugagaaacaccuguccaguugaccagaucaaaaacaacaguggcugucagggcugacugcuuucacauccaaugguaccuuuuuuuuuuuugagacgaagucuugcucuaucccccaggcuggaguguaauggcgcaaucuuggcucacugcaaccucccccucccguguucaaacaauucucugccucagccuccugaguagcugggauuacaggugcccaccaccacgcccagcuaauuuuuuguguuuuuaguagaggcaagguuucaccaucuuggccaggcuggucuugaacuccuguccuugugaucuacacaccucggccuuccaaagugcugggauuacaggcgugagccaccacgccuggccgguaccauuucuuaaaguagauacagacuuucucuacauuuggacucuuaauuuaugcuuuugaaugcugcucucaagacagcucauauuuugcaucuagaaaauaacuggaaaugcagagaauguuguuuccauaccacuucggcuuauuccuuccacguggagggaguuuaauuuguauaacacuccuggcuuuugacucacuccauccaggagaagugaagugacuuaguggauuuuuguaaauuuagugagaauuagcugcacaaacccagaauggcccgaccucuuuuuuucucuugggaaugagcugcccaccagagccaggacgacggugcacugagggagauacucgcuggaggcacuaaggcaacaggauuaacaguacccuacccagccuggagccccaggcaaagggaaacacaaguaacuguggcuggcugguuaucuaacucaucuccucuucuuucuagcacacagauauuauguuucuauguguuuugcagguaaugcuguguguuccagacagcagaaugugaguggacaucauauguaccaccucugggccuggaccauagaacucacacauaauccuucauguucuuaugugaccacacagaugaacaaagcaagccaaguguggaaacguguuaaagaugacggaaccacaagauggaacaagccuggaucccugaaucccuccuuggaggauuagugcccacaaauuguaaacagccacccagaucucagcgagcaagaaauaaauuauaccugaauguuuuaaaggguuuuuugguggggaaagaacagugaugauagauauucuuaaauacuguaacuacuuugaaagaagagaacaacaguuaagaacuaugucauuuuagucaucuuuuguuuugucaaaacaaagauguuacaggccugugcuuguuuaauaugaaaaaacucuaugaucuacaaauccuuggggauacagagaaucaggguagcuggugacaucugaccuauccucuuacucacugauauuguucagaaauccaagcuaagagguucuaaaauagcagggaaaaaugguaauuucuaugcacuugcauuuuuaugaaagaaaacugcaaaaaaaaaaaaaagguaauuucuauguaccugcaauuuuaugaaagaaaacccauuaaacaauaguuuauaauaaugcauccccuacacacugaacaauuucccuguuccuguuucaucuuuauaucuuccccaggucugcuucuuuuaagacgucuucacacguuaaucuaguccaagggcuggcaagccauuucugaaaaaggccaauauaaaauaucuuaggcuuuacaggaugugcggucugugcugcauuuauucaagucugcuguuguagaaucaaagacgccacagacgauauggaaaugaacaagcgcaacugcaucccaguaaaaugauuuacaaaaaagaggcagugggccagacuuggccguggacuguagcuugcugaccccugaacuagucuaugcccuaaucccgugguccccaaccuuuuuggcaccagggacugguuucaugggagacaacuuuucugcggaccaggaggagggggaggauucaagcauauuaugauuacuguacacuuuauuucuauuaguauuacauuguaauacauaaucaaauaauuauauaacucaucauaacguagaaucagugggagcccucaguuuguuuuccuguaaguagacagucccaucuggaagugaugggagacagugacagaucauuaggcauuagauucucauaaguagcucgcaaccuagauaccucgcaugcacaguucacaauaggguucacacucccaggagaaucugaugcugucgcuaacaugacaggagguggagcucaggcacuaaugcaagcgauggggaguggcugugaacacagacgaagcuuugcccccucgccugaagccuaccuccugcugugcagcccuguuccuaacaggccacagcccaggaauuggggaaccuugccgugaugaaucaaaacuagcugucauuggcugggcaugguggcucaugccuguaaucccagcacuuugggaggccgaggcaggcagauaaccugaggucaggaguucaagaccagccuugcaaaacucuuucucuacaaaauauacaaaaauuagccaggcgugguggugugcaccuguaaucucagcuacuagggaggcugaggcagaagaaucacuugaacccagaggcacaaguugcagugagcugagauuaugccacugcacuccagccuaggaaacagagcaagacucugucucaaaaaaaaaaaaaaaagacuagcugucaucuauacuucaccaucauuaaaauacagacaccacacacacacacacacacacacacacacacacacacacaaaugcacacacaauuuuuuugguuuuauuuuuauuucuuggcucuuucagagacaggucaacucaauucaaggacaguauacucucaauuuucucguaaaguccauuacuacaucucuucauaaaaauaaccacucacaaaaucagguaccauagggcuucuaaauuaccuaacaacaaacagaaauagcaccaaaaauugguucuuacuuuucacaaauccucuccacuaauuaucauuuaagauaucauuuacuauaugaaauuauauacuuuacauacuauaaauuauacacuacaaauuaagagaccuuuaugcuagcauuaguuuaccuuuguuuaaauaaaaaagcuuaauugucacuuuagaggcauuuuaagacugguugacacugggugccgauuuagugaauuuuugucaccaaguucaaguuugcuacagcugucaaagaucauaaaacugaaagcauacgguauuagcaaaaacaagucuuaucaguauccaugcaauuuuaaaaagaacagaaacuuggcaacuaauggguaauuaaaugucugcagaccaucacaugugaguacacccaguacacaaguaaucaucauccuuaaugagaaugagaaaauguuuaauucccacucaugccaaaggccacauacaagucuccuuccuccaugagaucuccuccuacuacucaacauggcuaucuuuuuucaaguuuaauaggcaaaccucucucagcacuugacuggaauaacuguugcaccauuugggaguuauuuuucuuuuagacauuugcagaucuuaucugaaggugacuaagagcccagaguuaaguauuugugaggcaaucuaugcgaacucugaacuuaccuaguuggcuuauaugaaauuuguagaacgcauggcaggagccuguguaagaaaguauuguccugguuuucuggugguuuguuguuguuguggggucugagaauguacagccaaccccucuuuuauaacagagaauugauuuugauacauauuuuaaaauaugauagugcagaguuaauggauguuaaaauuuuauuuucuuguuuugguagguagauugaauugagaaucauauaaucaguauaucugagaauuguaugaccaguauauuuuaaaauaugaucuuucuuuuaaucauauuuuaaaguaugauagugcagaguuaauggauguuaaaauuuuauuuucuucuuuuaguagguagacugaauugacaaucauaugaucaguauauuugagaauuauaugaccaguauauaauaagacuggcacaaccauuugccaucuuuuccuguuaucaucacauaguguggguggggagaaugaauggaaaucacuccagaauaaugacaaaugguuuuuaaaacucuaugcugaauacauuccagcugauaaugaccgacuuuucuuuuuucacuuuggugauaucauccucaggguaaaaaaaaaaaaaaaaaaaaaaaaggcauuuauaaaaaacaguuucauaaaucuuuuaguuauaaacaggaaaguuuuauauuaugugucauuucauuucuagacuguugaugaugaugauaaggaauuuggggccaauuuugauauaugaauguauuguuuuuccauguggugauuaaagcuuccauuagcaguuuaaaaaaaaagagugagaggagguaaaaggggcuggguacaguggcucauagcuguaaucccaaaacauuaggaguccaaggcaggaggauugcuugaggccuggaguuugagacuagccugggcaacacagcaaaaccccaucucuuuaaaaaaaaaaaaaaaucaaccaggcaugggggugcacaccuauggucccagcuacucugaaggcugagggcaggaggacugccugagcccaggauuucgagguuacagugagccaugaucacgcuacugcacuccagccugggugauagagcaagacccugucucuuaaaaaaaaaaaaaaaaaacggugugaaagagacugaagugcagcaagaugcuccaaguuuggggguuggggaacaugaagauaaagagccaacgguuuggucagcucaagaguuuggcuucuacucugagagcaaugggagucugccaaaggaguuaugauggagacugaugcuucgaauuggcuaaagguggaagauguccuagugaggagagacuagacgcacgaaacugcuagggcagaugggaacuccuggcaguggcagcacgaggcaaaggagaggacaagccagacacgcuuaaaaggccacugcuguguccucugcccugagcagcagagaggcuggcacacaauaugugcccaauacaggucuguugaauuaaacauuauuuuaaaagacuacuucacuuacauuaauauuuaaagaaggaagccacagcagauaguaucagagagcuguauaaauaauguaucacauucuagagagauacacgaaggauuuacgcuuugaguauaaacuaggagaguuuuauaauguucucucuucucuuucuucaaauaaacuaauaugugagcucaggauauuaauucaggauuuuccagggucuugaaggucuuuuacucaauccaaaauaaauaaaagagagguucaaaacaugaauaagagaucuggguuaaaaugaauaauuuauuaagcauagagacagauacuaguuuaauuauccaaggaaaacuaauuugcuucuuucuaaaacacacacauuuaagacuuuuuaaaagaaaaucauauacaacaaagaaagcuaugagagaaacucuguuuaugccaugguaaaaaaaaaaaauuaaaaugaccucaacaaaaauauaucacccccuuucccuacccacccucaaagccacaugagguuuguauuuaaaauaucuuuaagagccuuuuugcagcaauuagaacauuuuuauacaaacagucaaaaauuaucaagugacuuauaagaagauagaagucuccuaccuccaaaacaaaaaacaaaaacaaaaaaccauuacaagaccaccagcagagaagagagaguccuggugggcagacagcauuccaaaguccucuaaaacugauaucaacacaccagaaaagucaaagaaucucccaaaaaaucauguuuacaccaauaaagauuaaacaauuaaugguauuuuguuuacacuucuggaguuuucgggggauuuuuguuuuuguuuuuuuaauaugguuacaauuuaaaugggcauuggaguggaaaacugacuuacucagucaauagcacaguauagucaguuugucuuagauaacucacacuaugcaauuaaaaagccucugcuuggggguggaggagcaagccccuagcuggugauagcaaagacagcaccccgaaggagaagcucccagcaaagccugcgggaaguauaaagauuccagacaaaaucaauucacugaccugcuaagguucaagaauucugauuccucaaguucauuccaaaaaaugcuuuuauuccuuuuuuuuuuuuuuuuuuggcucaacaacuuccuaaaaccuccaaaccagcauguggaagaccuuacacauucacaaacucuuaaaacugcauuucugaaggcuuagucaguaauuuuuuuuuuuuuuuuuuugagacagagucucgcucugucgcccaggcuggagugcaguggcgcgaucucggcucacugcaagcuccgccucccggguucacgccauucuccugccucagccuccccaguagcugggacuacaggcgcccgccaccacgcccagauaauuuuuuguauuuuuaguagagacgggauuucaccgcguuagccaggauggucucgaucuccugaccucgugauccacccgccucggccucccaaagugcugggauuacaggcgugagccacccgcgcccggcccuuagucaguaaucuuaauaaggaaaaugguuuaacauuuucagggcauccuauauucuuuaaacauaucauaaaagcagcagaaauaacaaaguuguguuucccucaauccucaucucuugcugugaagacgacaugaaagccaaauuaaaaugcucagaucauuuuaaaucauaagcacucaagcaguuucaguuuucuucucucucugacccacugccacacucuuugcuuacacacacacacacacacacacacacacacacacacacacacacacgggggggguugggggggaagcacuacagucagaaucacaaugcaaaagugagaaauaagcaagguucuagacacuucagaugacauauaaaguauauaauacauaauaauuuccugccgcacuccauacaauuguugguguaaccauaaaauaaccacagucauuuguaauaauauacaacauuuuuacauguugcuuaaugagaguuuuuguacuugauauuuuaacccaaagcagagcccugcauuugauuauuauccuuuacaaaaaguacauaaggggauacucacuuuucugcauaaucaucuuagcauuuucaaacguucuagaauuuagccugaaguagggguaaucuaauaaaguaugauaaauaccacaaacaaaauauaagcagguggaaagcaucuaagauuuaaagagcagcuucaaaaaaaaaucccuuuugaaacuugagugguuuuaauuuaaaugccccaaaucaaccauaccaagcuaacuuaccuauauuccucagaauaucaaaaccaacugcuaucaacuuaagcaagagaugucuuauucgaguuaucuguccaaacaaaauuuuuuaaugccuuugguugcaccucagagacugucuuuuucauggagcaaugcagaaacugcaaccagacuacaggaaauacaaacaccagaccguacaaugaagccucucuggggacuaugauuauucaaagacaguucagccuugcagcaguaauagggcugaguguaacgacuuuuuuauucuuccaaacuaaagaauuuuccuuggacucucugccaaugaaacaucacagacuuuucugaggcuuuacaggcagaaaacuuguacgcagauguuucuugguuauacuguacacaucacuugcaauaaaacuguaaacaaacaaaaacaugacaaguucuuuaagcaauuuucagaucaucucugaaaacagaaggcacuuuugccugucagauuaaaucagcauucacuguggcugggugacugcuucuggauuaaagaaacuggaauauuccagugauuuggauaaugaaaaagaaaaaaaguuuuaaagguaagauguuaaguaugcaucuauaauauaauuggaauuuagauguaaggaauaaccuacauuaaucuggcuacaauuguacuucucacucccuugacuaauuaccuauaccaauaaguucuuaggaguguuauauccuuuaaacuuaggaacuucagacugcucaaaaauuaucaaguuaauaauaaauaaaauaaucuguguaaggaaaaguuccugaaagauacauaccuucucauuagcagugguucaccaucucaggucaaugaugaggaaggggaggcagggggcugcacuguaaguuuacuuuauacauuuauauaauuauuuaaauauuuguaauuacuuuuggaauuuugaauaucaaaacaaaauaaauuuaugcuccaauggaaucaaauacaugcuucaugcaaugaaguuuucaaaucaacguuucuuucacagacauugcaauuaaaagaucugcaaaucuuuuauucagaaucuugggccagcguaucugcucucagcaaugugaauaacuagugucaucaaagcuguuacuuuacaaaauagucaguguagucccuaaauaaaugucuuucaaauuccaacaacagauugucugaaucagacaccugaaaugcaugccaagaagucuugcaagcaggcagucuacgcaugaaaacaaacccuaugauagauucucuugaaauuaaauacaacucuuacaacaaagacaauuuuacuauuuuccgauaaacaggguccacucauggaaaagagaucgacuaacauggauaauucaucguccaguguuuacaguggcugaguucauuuaacccaaucuacuaguucuguaugugagaaaacugagaucuagagaaaagaaguuacgauuucuacuagugucuacugcauaacucuaugagucaccauucacaccacauucuauggacagaaacuucacugguccauuuacauuaaagaugauggccaugguggcccagaauugugcaggguaguggccuggaugacuuuuaagaugacacaaugauuuagaagcagaaucaggaucagaauuaucuccuuccucuccuuuaguuuaccaucaucuugccucauaaauguaugaaagaaagcaaaauacaagugcauuuaggauaaaacucuaauuuuuauccuugaaauggcaugaauacugcagacuaauccuaccuucagaacaucguauguauuaaaaggaaugccuauagaaacuagacacacauguacaaaacaaaauaacugaaacauuuaaagauguccuacaccauuauacuauauuaaauacuuugugucccaaagcuacaggugaaaacaagaauaaauauuucacucgcauuauccaaacuugaaucccuauuguuuucaauaucccuacugacuguaccacagaggauuuaaagagauucauaauuaugacugucauauuauaucugcuaaaacauaauuaucugguccugcuucccaguagaagaggccaguguacucucuacugaugucauaccaaggaagcacuuauggcuacaaucacugaugucaauuaacauaagaaaccaguacauucaguacucuaguagguuguugcaaagcagauuaaguuuuccuacaaagagaaacuaggcccaaaaccagacaaaguauguucaacuucuucuuauaacccacuaucauucaauguuagagaaaaucuaggcacuaaguaaaagcauuucagaucaucacuuuguaaacagccagaguaguucuucuaauuucugaaacaaucaccuguaauucagcaccaaaaaaacacacaaaggaauaaaagguaaggaaaaaccauaugaacauaaggugcccuugaaaaguacuggcauggaaaagacuugaagauuauauaacaagacuaauccauauuagagaaucaaaaggagauuaaacucccaaagauacguucagaagaaaaacuacuaugaacuaaauuauccuuccuuuccauauuguucaugcaauauacacacaugcacaacuuucccccacuuucaccuaguugggaugagauguuaauuuaggcugaaggacuauuauuucucuuuacuccuguuaugccagagaggauccaagaggaaaaaagauauacaguaaaauaaaaagauuaggaaucagagccccaaggaaaauaaaagacuguauuaaacaucacugcaaaucaaugucucugaaccgaauuuuuuaaauauuuugcaacgucucagaucaccauacguagugcaggagcaggggaagagucuucaagagucaugcuagccacacugucauuagagguggccuagagaugcucugggguuaccugaaacaagccaaaaagcccagugucuauaucaauggcuuuccuacauaaaggcaaaucuaggguaagauaccucacuuugauguauauguuacuauguuuucuguugcuacaccauagacuggguaacuuauaagccaucaaaguucauuuagcucaggguucugcaggcuuagaguccaagaacacaaaacuggugucugguaaggaccaucuugcugugucauaacauggagaagggcaucacauagugagacaguaagagccugccagcucaggucucucuucuuaggaagccaccagucccaucaugggguccacaccugaugaaauuaucuaaaucuaauuaccucccaaagacuccaccuccaaacauauaaaauuugggagucacauucaaaucauagcaauggagcaccaaaaucccacagggucuuuccaggaagaacucuugacaugucccucaucacuccugucuaugucaaccagcuuggacacagaucuacacaugcauggaucaaugacuagcauuucugagguggaagccagggcccacagcacacuauauaaaaauaagacuaggaggcacaccuaaccauuccaacguccauguucuuccccacugugcagcccucacaucuacauucucuccuuuagcucccucaccucauuauaugaccuuaacaauccugcugguaaaggcaguccccaacccacaagcauauaaucuuccaaaguuugccuggagauuuauuuaacuuaaagcucguuuuccuagauaaacgcuacuaacagcauuucucucuuaauagcauucuguuaagaagcucccaggcuggccuccaaucugaaacccauuuaaaccacaaugcagcuacuacuaguuugggaaaacacuagcccuucacaucugcauaaacgccaaacagcugaacaccaguuaggacuuuguuuccaugugucuaaaagaaacaaagguguugcuuuuccuacuugauucuggcuaguaccaccucagucucaaaucagaagaggauaaggacuggggaagaaaaugaaaguaaguuuaccccuuucuaaaaugugaagaaaaggaagcggaggugaugccaccaggcauuggggugaaucucaugagaagaugcucaacaucauuagucuuuagcgagaugcaaaucaaaaccacaaucagauaccacuucauacucguuaggacaccuaugaucaaaaugcuggugaggauauggagaaauuggaacccccuugcguugcugguggaaaugucaaguggugcagcagcuauggaaaacaauucugugguuccuccaagagauaaacauagaauugccauaugaucaagcauuccacucuuauacccccaaaagcagaaaauagagacuccaagaaaucuguacauccauguucacagcagcaguauuuacaauaaccaaaaaguggacaccaucaaaggugucaguggccaccacugacagaugaguggauaaacaaaaugugaucuauacauacaguggaauauuauucagccauaaaaaagaaugaaauucuguuacaugcugcaacauggcugaacccugaaaauauuauaaguaaaaaaaaaaaaaaaaaaaaaaccagaaaaggacaaauauuggaugauuccacuuacauaaagcaccuggaguagucaaaugaauagagacagaaagucaauucgagguuaccaggggcuggggcaggggaacauggggagcuauuguuaaauggguacaguuucugugugggaugaugaacaaguucugaaaauacuggugauaguuacacaacuuugugaauguacuuuaugccacugaaccguacacucaaaaaugguugaaaacguaaauuucauguuauauauauuuuaccauaauuuuuuuuuuaaagcaacaccacaaauuagaagagucagagcuaauggcuucaccuuuggauaccucaaccuucccaaucuacagaauaggagaaaaauaccguaccaccuccgggauccugaaacuucaggcugcaucaugaguaucugagaccucaaaugcuaaauccucaaauguaaagggucuacacgacagcaugcaucacgcccuacacaccugccagguggaagcuuuucuaagcuagauggucgcacagaaagcagccauguguacauaugaacaaguuuccuaaguuugcaaguucuuuguuaaaaucuucaaugaaauucucacucuauuaacuuaacuaucauaaaagagacauuauaucauagaagaguaaaauuaucauaguaaccacagcaaguaugcugacaaagauguuuucgauguagcuguuuagaauaaauuacuaggacaaacaucuggacccauggccaccaggcacugggcaaacagagcucagguacagucuccuggugaggcagccuggccaaccuggguuaccccagugggggccuaaaaauaaaagugacaagacacacagcccgauacugagucgcaugacuacgcaggcauuucagagugaagucaaggugcuuagguuccuacugggccgccaagccauucagcaucagcgccggucccaucugcaggcaaagaaugacacaacuaccucuucauggaauauucccagucaaagcccacuuaauaacgagguccuucugcaggguuaaacaaaccucaguuagaaugcagcauggugcugaguggucuuucaaacuugcuuguauuuacagucagccaacugcagauugaacauagucgggagaaaaaaaaacaacaauacaaaauacacuauaacauaacuaguauaaauguauuuacauagcacuuacauuagguauuaaaaguaaccuagagaugguuuacagucuauggaaggauguguuuuuauaugcaaagacuacaauauuuuauauaacgaacuuaggcauucucagauuuugguauugacggugggggcgggggugauccugguaacaaucccugcagagaccuacagacaauacacagaagucucacauacgaggcccagugcagucaggccuguaaucccagcauuuugggaugccaaggugggcggaucaccugagcucaggaguucaccagccuggccaacguggugaaaccccgucucuaccaaaaauacaaaaaugagcugggcauuguggcacaugucuguagucccagcuacuugggaggcugaggcagcagaaucacuugaacucgggagguggagguuguagugaggugagacugcaccacggcacuccagccugggugacugagugagacucugucucaaaaaaaaaaaaaaaaaaaaaaaaaaaaaucucagauacaaggcuuacauaaagaaagcauucaauaaauguugacuguaaauuagauuuuccuugcuauuaaacauuacucauaggugacgaugagugauauuuaaucacuauuaacaacuguuuuccuaucuaaauacaaauuuaaggaaauauaugcguaauacucccugggcucucuccucuuuuaagaccuaauuguaauugcgcuuucggagagcaauuucaacagcuguaagacuugauuucaugauaucuuacuuaaaauggaaaaccugggugugggcuuaguccacaacaacccccuuucucugaacacagccccuccuacucacugagguggguuccacuaaaugaacuagugaauuagcccucgugcagacacuuaagucuaacaguaugcaauuuucccacccccagcauuuggauuugaaacagguggcuauggccgggcacuguggcucaugcuuguaaccccagcacuuugggaggucaaggugguuggaucaccugaggucaugaguucgagaccagccuggccaacguggcaaaacuccaucucuacuaaaaguacaaaaaaaauuagccagacaugguggcgcacaccgguaaucccagcuacuuggaggcugaggcaagagaaucgcuugaacccaggaggcagaggcugcagugaguugagaucacaccacuguacuccagcuugggugacagagggagacacugucucaaaaaaagaaaaagaaaaaaaaaaaaaaagaugucaggcacagugugucccuggaacuaaauaacauaaauccaggcgcugugcaucagccaccuucuccacacacccaaaagcagagaaagcaaaucucuacagagacguggaugggaccaacauaccaaggggagcagaaaugaaaaacagugaagguuagauugccucacugacuugguuccugagaaccugccagacacuaaguucuuagaaggacuccauauccuuaucacacccauccaguuuuugucccuauuugcuugaauuuuuaugacuuuccauuaagagucucaagaaaacuaucgucagaaauuuauuauaggaaauauuucagcagauuuucaguauauuuuccacaucugugaagacuuagaaaugaugaaaauguugacaagaaggaauuagaaaaccacaguacagugauucaauaaaaugcaacuauuuauaaauuaugcaguuuacaaaacuaggaaaaauauuuuuguguuuuaugauuccugcuauguaaaauauguagaaaaagcaacacaggaaaacaaaaacagauguggguggggguauggagcugugggucacugaugccauuuuauuaucuugccuguguuauuaaacuaggaagaaaaaucuaauugccaaaaacuugaaauaacccaaauguccaucacggguagauuauuuuuuuuuaauugugguacauucaucugaugaaauaccacuccacaacagaaagguaaaccauugauacacaaaccacacagauguaucucaaacacauacgcuaagcaaaagacgucacacacaaaagucuccauacucuauaacuccauuuauauaauauucuggaaaggcaaaucuaagggaacaggauugguguuugucuaagaaugggcaaagacugaaaggggcacaaggaaacuuugaaauaaugaaaaucuauuuugcugagugugguuggugguugcacagcuacagguguuugucaaaauucauuguacuauacacccgaaaagugcaaauucugcuauauguaaauuauaccucaauaaaccagacuuaaagaggagggcaggugugguggcucacgccuguaaucccagcacuuuggagggaggaggcaggcggaucccuugagcccaggaguucuagagcugcacggugaaacccugucucuaccaaaaaauccaaaaauuagccaggugugguggugggugccuguagucccagcuacuugggaggcugaagugggaggaucguuugggcccuggagggggagguugcagugagcugagauagcaccacugcauuccagccuggguggccgaguaagacucuaucuccaaaaauauauaaaaauaaaaauaaagaagacacugagcucagacaccaaaccaaagcuacugaggcaccuguaaggugucuguuuuauaauauuggaugacauucaucauucaucaaauguacugagugcccaucuaaugccaaaugcucugcuaugagcuaguacagagugaacaaaauagacaaaaaaauagacacaacuauacaaacaaacuacaggucacauaggaaagcauggaugcucugauugcuauuacgggauuaggggucaaggaaggccucucugaacaagucacacaagcuuagaccccaggaauaaguaguagguaaggaggcagagacuggaaagguuucuaaaugugucauuacagcaguaguuaacagcaacucaacuguuucaacaugugacgggugguuacaguuuacuauuuugcugugauaaggauuauggccuccuacauaagaagcccuaguaaaugaagguuuuaaaacagccuaaagacagugaccaggagacguaaugauguguuuuggauuucagggaccaucaaggaguacguuccuccaauccuugucaauauuucaaaaaugaucaacacauguauguauuucccugaaaugagguugccuauggguaaacuaaaacccauguucugguguuuaaaagauuuguuguauuuguucuuacuucuggcugaauuugccauuauuuauuuaacaagguuuccugaagcuuaucaacguuucuaaaugauaaugacacucacucacucucucucucaccaaaaauuggaaaaaauggucccaguuugacaaaucgaaaccucuucacaauacgggaaucaaccuuaaagaaggcccccuucacuuggcuucagaggcccuacucuaucuugguuuuccuccuaaacucacagacuucucuuuggcaaaugccucuaagagauucuucuuugaucaacauccaaguguuggagggggggcgggggcagccccuuauuccuucucuuccuucacucacucuuguuucaaauacacuccgauaacaauucccacauacucaucucuagcacugaucuuuccccaaagcuccagguuugaauucucaacugucaaugugacaucuccacuuacauguuuaacaggaaucucugacauggguuggauguguguccccuccaaaucucauguugaaaugugauccccagugguugagguggggccuggugggagaugacuggguuauggggguggaucccucaugaauggcuuggggcuguccacaagagggagucaguucuugcaacaucugguuguugaaacuguguggcagcggacucugggcacacuuccuauggcuuugcccugcuccacaagggacagccaaaaaaaaaagugugguaccucccccguccccuugcucuugcucucaccaugugacaugacagauuccugcugccuucugccaugauuggaagcugccugcggccucaucagaagcacaugccagcaacaugcuuccugcacaaccaugagccaauuaaaccucuuuucuuuauacauuacccagccucggguauuucaaucuagcaaugcaagaacagucugauacaaucucaagcuucaagucuaaaagggaacucugggcuuccagaccccugcccauuuccuucuuguccuaguguuccugguuuucaacaaaagacaccaugaauauaccucaagccaaaaaccuaggagucagcaauaaucugccucuuucccucucuccccaguagcaacuccgacaggcacugccuucaaaauacauuucaaaagcaagcauuccucaccuucacuauuaucccagguccaagccaccacugucucucucugggacuacuaacuggucaaaucaugagccucugccuccuuacaauauauucucaaaacagcaaccagagucauccuucugaauuguacucaguuccugccauuccucaguccaagccuucuaauggccuccuaucacaucuaauacaaaaaagggacccagugaccuaagacaauaauuagcaacagacuaaccuuuaugcaaaaggugacgugaggcaucaucgaagguaagggagugcucacugccaugacaaaucagaugacacagcuuacacuucauagucaauccugaggggcuguggaagaaucuaggaaacucaaugacauuucaccccuaaaucaacaggugugcaaacagaauuauccucuuaucuaaucagaucuccauaaguacccugaaggcuucaaggaauaagagugugccuguuuuugaccacggauuauuuacuugcacaacuucucaagugaucuguuuccaccuaaaauggaacaaaggagucucuaaaagaaauacuacguuucaaauaucucauagccaaucagcaaacaacuaccauucugaaaagauuuugucugaauuuccaaucaaaguuucuuccagcccauaugacuucaacauacaauuuguaccacauuguaaccaaagaguuauuaguaagaauguuaaauaauccuccccuaaauuucaacuuaaaauguguagucuuuguuuaaauggccuguugucugcaaguuuugaaacaaggcuucacuuuguguucaaaggcaguauaaggaaacaagacauguuacuguuucgauuccucugaaugacagugauuaauauuaaacacaagaguuucuuacaaauuagaauuauccagaaacauaucccaguaagccuagccucauaaaaugacuaacuucaauauuuacuuucauuucuaaaauuuuuuaaaucaaccacuaagacuuuaaccucccccuacacacgccaagaagaaaugcuggcucuccccugcacuggccacaccugucuuuagacagcaccccuuuccugcucgacggccuccugcccccaucaugugaucaaccucuggcaucaggaaggcagugguggcucugugccaugaggucccucuuuguaggcuguggcuauuuuugggcuggcagccccucugauuccugacuuggcccuagauaaucaugaggccgccuuuagagagaaacccuucagaagccaggcaggucccugugggauuagcaacacuccacugcuaacacagcaagucucagguccuaagugcuauaaaggcccuccaaggacagcgcccucuaaccugauggcccucgguuggccagacccaaggcugggcucccauuucaaaugggcaaguccgugguuuuauggggcuaacaaaucaaagcugacacagauauacuacucauacauggauuuuagccaggaaauuucaaacaacucaaugaugggauuuuuuuccccccuuaaaugucauguccauucauaacagugagauuucagauguguguaacagcuuugggaaaagguauugauaaaaauauucaaagaaaauguuagucacuuuucaaaaaaagcacagcauaccaagaugauguaguaaguuaaauauucccuugugcuauuuauagacauaaccauauacuguaucauuucuaauuggaaaaggucuaccagagauacuauacaccugauccuaaaacuauacauuaucuucugcuacgccucuaggaaacaagacuauaauaacuugaauuuuaagaacuacaaauucaagauaaauauuugauugguuuuuccaucucacuauuaaaaugaagcauaagacccucaaauuagguuuaaauguuuuaacagugaaguuuuaugggagaguacauccaaaaauacagagaaaauacauuuauguauuucauaucacaccuuuccuccaaggccaucaugacaucaaaacugaucccuuuucuuuaucccuaacuuggauuuuguaaagaauuguaacaucuuuucugaaaccacaagucuacaguguaaaaaauguuucauucccagguuucuacuggcaacauuaaaugaagaccuuaugaaaccuggccgggcaugguagcucacaccuauaaucccagcacuuugggagacagagguggguggaucaccugaagucaggaguucgggaccagccuggccaacauggugaaaccccaccuuuacuaaaaauacaaaaauuagccgggugugguagugggcgccuguaaucccagcuacucaggaggcugaggcaggagaaucgcuuaaaccugggaggcggaguuugcagugagccaagaucgugccauugcacuccaaccugggcgaagagagugaaauucugucucaaaacaaacaaacaaacacacacacgcccuuaagaacgcaaugaggauaacauguuggcccuuguauuugagaaggcaaccuggcuugacucugagcuacagcuccaagaaauaaagacgauuugcucacugguccuagcucugacaauaagcaccugcccagugaagucucuggcugugaaggugagugagguguucucuccauuccauccauucuggaguuggaauuuuccaaacacugcuaaaggugggggugugccaggaaaacaaaggaacacaacauggaccagccaaguucccucucuugcccucauaagcagaacaaagucucagcacuccaggacuggccgcuauuugccuuucuuagaugggaguguaggaagagggagcauaccaggccuuagaaucuguccucacuagacauggaggaggagaugauguaauuuuuuuuuuaaauaaaaagauaugcaaugcgcaugcuguugugcuaugagaagaauguggaaauucacaaguugggcauuguuuagcuuuguaucccuguggcuacuguguucaacucagccugaggcuccaugaagacgguccuugagucugacuuccaagggccugacagccuauuggugacagccuuuacaaucacugguaucugaagcucaagcaagacagacaccaacuaaguacccccagcaguaauuucucaaaaaacaauucaguaacaugcagacuccauccuuaacggcaaucugaggcucugcuguggucaacaaauaccacugacaguggcccggaccaccacuccaauucccaaagaccuaugggccccgaugacaugaaggucacucagagcuuaaaggcagagaugaaugcaaugaagauuuccacugaaagauggcagagaaauguucuacccacacucacccaauugagauuuguggaauucaacagcccccaaacguuuuaaaagcaaauaauucaguauccauucaugccuuucuccaaaugauuucaacucuucauaaaguaaucauaaguuaaauaaaauaacaucucuccuuuugauacuaacuuccuauagcuuagccguuauaggcaaaauggcagugugguuuaacugaauccacauuuacaguugagaauacuccuacucccugcuguuacaucaguguaagauguuuuaguuggcaaucuaaacccugcuaauuuucuuacaacuguuuuuuuuuuuuuuuuugagauggaauuucacucuuguugcccaggcuagagugcaaugucgccaucucggcucacugcaaccuccaccucccacauugaagugauucuccagccucagccucucagguagcugggauuacaggugcgcaccaccaugcccggcuaauucuguauuuuuaguggagaugaaguaucaccauauuggccaggcugguuuugaacuccuaaucucaggugaucugccugccucggccucccaaaguauugggauuacaggcaugagccaccauauuaagagacuuucaagaaugaaaugaucccuguguaauuuuuacgauugaguuccaacuggcuacaaagagaggaauguauacaauagcaugcagaacagucuccgagaaguuccguggcuacagaaugggggcauuucucacaccacucugucagcuuccuuaucccuguuacagagugaccuuuuuauaacaagaagaacuuuuuuuuuuuuugacacagaggcuugcucuaucacccaggcuggaguacaguggugcaaucuuggcucacugcaaccuccgccucccggcuucaagugauucucgggccucagcugccugaguagcugggauuauaagugugcaccaccauguccggcuaauuuuuguauuuuuuguagaaacgggguuucaccauguuggccaggcuggucuugaacuccuggccucaagugauccaccugccucggccucccaaagugcugggauuacaggugugauccacugcgccccaccuauaacaagaacuuuuauucaugcaacaaacauuccuagguccucuaucacaugcagcuucuuugcuaggugauggggacacaaugcugaacaagauggucccagccuucaaagagccuccaaagagccuccaguucagccaggaagacaaaaauguacaaguaaauaauuacaaaaacugcaaagguagaagcgacuggaggcuaaagggacccagagaauaggcuccacuguuacagauauggagaaaacagugaaaugucacuuccagaagaagauaaagcuugagcugagacuaaggcauaggcaggugagugcuucucagccuuucagauuuuauggaccugugacauccacacuccaaaacucugcagagacagcauggggaugucagcuuuaauuuugccaagaggggcacuucagacaaaauuuguacgacugccaacacaucauaaaaggacauuauuuuaauacaaaaagugaaagggguacaaaacugcagcauaaagaacauuccuuuaguuuacguaauauacauuuagccuuaugaaaaucuugguacacuguauuuuuauuccaucucaccguguucaagucaacauucugucaccagguaccccagggucacagaugcacauuuggaaccucugaucuagaugacaaaggcagaucuggagggcaguuucucaccucugcaaagaucaaagcaacagaccaggagagaaagaaauacaccaagggaaguacugagagggccgauggaucagcaaaggccuaaggccagguaccaugggucaugccuguaaucacggcacuuugggaggccaaaacaagagaaucuauugaacccaguucaagaccagcccgggcgacacagugagacucugucccuaaaaaauuuaaaaauuagccagccaugguggcacaugcccauagucccagcuacucaggaggcugacaccagaggaucacuucagcccagaaguuagaggcugccgugagccaagacugugccaaagcacuccagccugggugacagagcgagaccccaucucuggaaaaaacaaacaaaaaaaagcagcuuagaacacgucaaggaaggucaguguauucugacccuucuugcaauggaagccacaucaccaacacacgcacgagccuaggacagaggcacccaaagaccaagcccgaugaguuacuuccguagagaccagagaggucuggaaggcagugccuggcagcagacaguccucacccgcugccaugaugcuaaaaccuccuccaggacccaggcaccaucucagauaaaagcucuucaaggacccaggcaccaucucagaagugggugagccgcugaggaaggaggaaauccauccuucagaggagagaagagccucagauaggaagcgugaacugaccacacuuaaaauccucaaggagauauuuaucugcaagcgacucuuugaaaccaaaaaacacugaguuaucuugagguugccacauuauauguucucuacaagugaggugaaaugaggaugugugaggcaguuggguuauaaagaaauaaaguuccauuuggggucacaaugugaauguguaagugucccaccugcuuccguaguugagagacuggcuggggcuggaagaaauggauccacccgagcgguaugaaggagcuggguuucauaugugauauuaagaguuaaggugcuacguuaacaaccaacauuuaacacugcagggguagcgcuuuaucacaagagacuuucgcucaggccacaguacaucaguucuucggaucccuuaugaacucuuccaccucaaaccagcauauacuguuuuguaucacagcuauacauuucagaaagaaaauaaaaguugaauuuuuaaaaaagacucuuuccuaguacacuugacaagcauuguggagugaggcugaccucauugcugaaaagcgaucggaagcuucaggacaucauaagggcuggugagagaaagcgcuguguaaacacaguguuuggcaaauccaaggacugccaaggaggggccaccgcucccugacacccugucaauuccacugcuccacgccaggccagcacaguuugugaggccaggaugaggaacaggccacagccuccagcauggguaaagauaacgacaucagugcacagcucuucaaaguccacaguguucccacagucauccucccaguagacagucccaugugacagacaggucacaugacagucacauucccccaucccuccuccucugagaugcuaaaccugauguuuccagaaguugaguaccuugcucaaaacacagaguuaauaaauagcagcaauggacauuaaacucuacuccaauguguaaucuugaucuauuuccaccuuccuucucacaauaacgaaaucaccuaaacaccugguaggucugcacagcuauggaccuuauagccaccugauaugagaagcauacguuuaucaaggagcuccuaaacugacucaggaacuggguuaccuguuacaagccaaaaauauucuucgccucauuuuccucauggacaaaaacugauucaacaauccaucucauagggucguuuuagaguuaaauaaaauuuuuggaaacuuucuaauacacaauuguacauugcuacuguuaugccaacaaccuuguaaaacaagccuuauuaucauccucacuuuucugaugaccaaagcucaauaguuuauucauccagucacgaagacuuucuggcugggcacaguggcucacacuguaaucccagcacuucgggaggccgaggcaggcggaucaccugaguaaggaguucaagaccagccuggccaacauggugaaaccccaccugcacuaaaaauacaaaaaauuagcugggcgugguggugggugccuguaaucccagcuacuccggaggcugaaguaggagaauggcuggaacccaggaggcagagguugcagugagccgagaucgugcccuugcacuccagccugggcaacaagagcaaaacuccaucucaaaaaaaaaaagacauucuaaggugauggacacauucuguaucuugauuggugugaucguuacaccaauauguauuugucaaaacucauauaauugcacacuuaagccaggugcacugcauuucaucacacuuaauguuaucucaaaaauuguuucaaagaucaugugguagugaacagcaguguguauucugagacauauucaugaauucuuauuggaaucuacagauuuuuuccgcauucuuuuucuguaaucugcuugccaacuaauccuuccuacccaacagaaacccuuaaauguugacgauagcuacuaguuaccguuucugucucuuuacucagaauuucauguuuuacuguuacauccugaacauauucaucuagaaccuuccacugaaguaggucucuguccacaacccaguaggguacgacagccacagacuaaaccaccaccuugaaaagcaggcuaggaaggaucaugugccagcugccugcaguccuaacucagccgacuucugagaaucucaacuauauuucucaaucuaagucaacauuccuucaacaguuuauugaacaaaaauaaaaagcacaauucuaaauacuccucccagaggaaggaacaaaauaaagcccuugcucucuuagauaucacaucauauuguagaugauuuucaaaauuccaucagaaaguaaccuuugucaugaaaaucaguaaaaaagaacaagaggcaaaacaguaaguuucaggauaguacuggguccaaaguauuuacuuuuauacaaugagcuguuuguauagaaguaaauaauuaaaagcaccaucuacccccagggcuuaucaaaggcacucucaaagacuguacaguuaugcuaaagaaaugauuugauguacagacugugcaugcuuuuaguugucuuuuuuuuuuuuugagacggaguuucacucuuauugcccaggcuggaaugcaauggcacgaucucagcucaccacaaccuccgccucccagguucaagcgauucuccugccucagccugaccaguagcuaggauuacaggaaugagccaccucaccuggcuacuuuuguaauuuuaguagauacaggguuucuccauuuggucaggcuggucuccaacucccaaucucaggugaucugcccgccuuggccucccaaagugcugggauuacaggugucagccacugcccccggccacuuuuaguuuuuaaauuauaugcaguuaguuuuuaaaaacuaccuaaaagguagcucagacuguuugagggacguggggguagaucgcgugggcagggcagaguuuacagcugaaauauaaaaucuuuaccccaaaguguuaaaugaccaugaacauuuccuuguuuagaaacuucagaguuguccucucucuccaaaguccacuuggugaaaaggaaauaauuuuccauuugaaucacgccaacaccaaauggaaaaugucuuuauguguguguaguuacgcaaguuggcaccucaccuuauaccucccaaccuuuauuaaacaucgacuuccugcacccuuuucuugaaaaugauuaccuauguuaggcuuucugcuagcaagaguucuuuaacagaaggugacuguauauacacauuuaacucacagcagcagcccaacgauagccaaccuccaaccagggccuauuuauacaguccuaacccuauauauuccuuagaagacaauuuggaaauagagaacugaugacuuuuagggcuaaaaaucaugacugauauucagcugaaacugugguuuugugagggcauucgucucuucccaguucugacacuggccucaccuccuacuucaguuuccaucugggauuaccuccauuuccuccacuaauuaccugccgcucaguagcuuacaauaaggaaacagaauucaagauuucuacuuuuaaaaaaaguuucaacugggcacgguggcucacaccuguaaucccagcacuuugggagguugaggcagguggaucacaagaucaggaaaucaagaccauccuggcuaacauggugaagccccaccucuaauaaaaauacaaaaaauuagccagacaugauggcacacaccuguagucccagcuacucgggaggcugagguaggagaacugcuugaacccgggaggcagagguugccaugagccgagaugaagccauugcacuccagccugggugacagagcaagauucccuuucaaaaaaaaaaaaaaaguuucaggaaaaaaaauaguaguugcuauccagcauauaagaccacagacugcuaaucuaugaagugagauacaaaaaaucuaauuauucaaaugauuguuucuauacaguucuauuaggacuuauugcaaaaagcagucugaaagcuauaaaguccuauguaaguggaauucaugauuguaaugaucucuaacugucaauuuuucacuugugcuacuaaucugaauggcuuacaacauuuaacauucggcuuuacguucugugauuagaaaaugugaaaauaaaccguaauucucagcuaugucauuugaaauuuuacauaucauaacuacugcaugacuuggccuggcacaguggcuuacuccuauaaucccagcacuucgggaggccaaggcagguggaucacuugaggucaagaguucgagaccagcguggccuacauggugaaacuccaucucuaucaaaaauacaaaaauuagccgggcaugauggcaggcaccuguaaucccagcuacccaggaagcugaggcaggagaaucgcuugaauccgggagguggagguugcagucagccggaucguaccacugcacuccaaccugggugacaaagcaaacuaucggugggggcggggagaaguuuuaucccauuucagcaccaauguauagaaaauccuggcaacagaaacuuauuacuuccacucgcauuaaaacuagucaaauaacagcaucauacugggugugggaaauggaccgguacaaguccagucccaguuccauaacuuacucgccauaagacaaaacauuuauccaaauaguucugguccccagucuccuucaguauaaaagaaagcacucaugaccugcucugcccaaccgcagggcugaugugaucaguucuuaauaucauauuuacaaugugcuugccacaaacauagggaauuaauauuucacuaugcuuaaaagaugaaaauacaaaauugcuuuuauauuuaaauacuguauauuaauaguaacauuuuacaauugaaacucuaaaauacaaauauucuggacuauguuacaggugaaaaaucagaacagggaaccuuaguacuguaauauccacaaguccaagauuaguucaaagugaugacucaauugucuuucgaaugugcugacugauagcaaagaggcaacauaauuuacagacuuuaccaaagauaaaaguaucuacauugauuuuuugaaaacacaguucaaauggaguaucagcagcucacuagacuuaaacuuucaagaaaaacaagaggugacaaagcuggagucugagaauaaacaaucuccaauguuugcuacaaaucaauuccuccuaaggaagagggaaaguuaucagccuccugagccuagaauuuaacucccaaccgacagcaccagcagauccaagcaacaccuccaaggcuaagcagcagaaauuaaaugaaacaccuaucuaugaaucagaagauuuaauuuaaaacuagagacuaaggaagguuauuagcacccauugaucauuuucuauauaccuggcaccugugucagaauaaccccaggagacaagguacuacccccaccuuccagcguccugaugagccaacuggggagcaaagguaaugaaauuucacucaaggucacauggcuaauaggaaaaucucagacaugaacccaauuuugccuguuaagucugugcacucucuaugacauuacugcaccaaauguccuggauacccauuacauuuuuccaauucuauaauaaaguauguccccaggguuucauaauggaugucauggugggcaaaaucuagcuaaauggugaaauaccucuauuuauuauuugaaauucaauaaaaacaggaggaaggagagaagaaaagcagucccuagcacugaaggauggagggcuaaucauucaagaucaaaacaacucacaccauauaaggagaaaauaguuuucauuugauuauauaucuacaagguuauacauuuuuaaauguucagccuaauaagcuguaaccagaacuuuccaacaaaauagucuuaucugcaauauaaaaugguuuagguuuucucauagaaacagaaauguaggauuuuucuuaccucccuuuucauuaacugacccuacucuuuuaaauucaaauuaagaguaaguaaaucccuuugcagaggugccaucaaaaacacuauaaagcaacaucagaaggcugggcaugguggcuuacgccuguaaucccagcacuuuggaaggacaagguggacagaucgccugaggccaggagauugccaccagccuggccaacauggggaaauucugucucuaccaaaaauacaaaaauuauccaggcgcgguggcgcauaccuguagugccagguacucagaaggcuauggcaugagaaucacuuaaaccugggaggcggagguugcagugagccgagaucacaccacuguccuccagccugugacacagcaagacucugucucaaaaaaaaucugaaagcaaaacaauuuuuuaacccuuaaacagaaaauacuucuucacagcauuaaaucaaguucaauaaccagcaagucuagagaacuauugaaaaguuuuacauaaaugcaaaacuacucugaaacacaaaucuuauuagauguaaugagaaaaaagaauccuagacugcaaaguuaucugaauuccuaaguuguacauacauuuuucucuaaacagaaaacagcccaagucccuagucaaaagaaauugucaacuugcgauugucugcacgaauagggaaugucauaaaucaugaguggaaucaauuacguacauguauuugcacauggguaugccagauguucucaaacugacucuucauaauaaaacaguaacucagaagcaucaggaaacuuggcaccuuccagcucugaugcucugcucccaaagccauggccguucagucggacacaagacugaggguaaacuaccuucccucugcuugcugaguaugaaacaauggaugagggggugagggcaagaggagagggcaaggagcaaggcacagaaaagcaauaaggaaauuaauaccugugguuuaaaagaccuuccaguagcugugacuaucugacaaaagaauuucaaauucccaugccaucagagcucuagaugauuuauuccagaccacaucugggagaaauaauuauaaaaguaaaaauguacccagcauccgaacauuuagacccuauccuuaaggagcuuacaagauguagcaaaaauauacuggaaaagguaacuaaagauucucauugagagaaauuaagagacgccaaagaguacagugcuaaguauuuuccuucuuaauccuuuuggugagaaggaaaaggguaagcaugauuaaugacaaggaugcuuuauauaaccaagaaugucaauacaaccuacgugaccaaacuuuggucaagucagcagguggaauuuuuaaugcaaagcccaacguuaacaaccugggagaauauuucgaacaacacaaacacuuacuaacaucuccaaaacugcacuuuucacaaugauugggguuucucugacuccuccaagaaaagaggucaaauucuuuuuuuucucuucuaccucaguguuuggcccauagaaagugcucaaaaauggcugaggcugaggaaaaccaaacacaggccgggcacaguggcucacgucuguagucccagcacuuugggaggccaaggccgguggaucaccugaggucaggaguucgagaccagccugaucaacauggugaaacccugucucuacuaaaaauaaaaaaugaagacgggcgugguggugcaugccuguaaucccagcuacucagaaagcugaggcaggagaaucgcuugaacccaggaggcggacacugcagugagccaagaucacgccacugcacuccagccugggcaacaagagcaaaacucugucucaaaaaaaaagauaaaagaaaaaaaaaucaaacauaauauucuaacagcaaggauuuuuacucaugcuuuuuauuuaucauuuuacaugaaauauaagccuaacuauacacuacguauaaaugacuugguucuguauguggggccuagauuggggaucuaauacaacacgugaauuuuucuugguagcuaggucuuggcauggcucagcccuuuuaaauccauuucucauucuccaauauccuucuacccuauccugacccaccagcaaggaggacuucugcaauccucacuucaauuaaagccuguuggcuuagggucacaguaauaagcaaauaugguucaauucuguaauuugauuaacaacgaaaugauuaacaguauagcaguuuacaguauaauaaaaaauaagauuuuaacagugcaaggugacuuaaucagaauucugggaaauaugacucaaccaccuugacacagaggucaggggaaggggguaggucuauguuucaaugucaucucagaaacugcucauaucuaugcuggcuucuauuuucauuccguaaagcuagccaagggagcuauguuuuacgaggacaugcaguuucaacuucguaucauucauagcuaacaaucaugcaaaaaucuacaaaauaaacauuaaggaaaauaaauuucuuauuugucacugaacacugcugaauaccuccuaugaacugcuuaucugaaauaaggugaagaaauauugauucuuuucauccagauugguauauguguaaauaacaccugaguuaaauauuaccauguuuccaauguacaaaaagcauaaaagauaagcuaacuacccaacagucaagacuuaaugaacacugucacaaacauuauuuacacaagaauguauguuacgccucuucuuccuagucuccugauaaguaugagucuuucccaagauucccuuuucaaugucauuuuaggacacaaaauguccuuaaauguuuuaguuaacaguagaagaucagaauaauuauauuugauuaguccucaaauuuaaauacuaauuuucuuuucuucugcaucaugcuuaagacacaauuuacuuauaagguacacauuuaugcauuuaaaagaauaaggucauuuaaugguuuaaaaaccucuuccaauacaucuuaccugaaagacugauccauuccuagucuguucuucccuuuagaugaguucacacuguguccuagcaauaaagcuucuagguuagaaugaggguaaaauguguguuuuucuuacuuuuauuuauguagcuaauguguauacaagaauauuccuuuuauuccuuuuuagacagagucuuacucugucacccaggcuagagggcagugaugcgaucucggcucacugcaaccuccgccucccggguucaagugauucuccugccucagccucccacguagcggggauauaagcacccaccaccacaccagcuacuuuuguauuuuuaguagagucggguuucaccauguuagccaagcuggucucaaacuccugaccucaggugauccaccugccuuggccucccaaauugcugggauuacaggugugagccacugagccaggcccaagaacauucuuuuuuucuguuuuucuuuuggagacaaagucucacucuguuggccaggcuggagggcaguggagcgaucucagcucacugcaaccuccgccuccuggauucaaggaauucuccugccucagccuccugaguagcugggauuacaggcgcccaccaccacacccagcuaauuuuuuguauuuuuaguagagaugggguuucacuauguuggccaggguagucuagaacuccugaccugaagugauccgcuuggcuuggccucccaaagugcugggauuacaaugagccaccacgcccagccccaagaacauucuuacuuuagauaugggccugcuagcaagauuuaaaugcaguuuaucuuugaauaaauacauuuuuauuacuuuacaauauacagcuugaagucuaaacuuuaaugaacaaaguuauuuuguaaucaagauuuauaugcaaauacguacuucuaaaguaccugaaagcuauuuacuuaagugaagcacuuccaaguucgaccuuguucacacucuaaacuuguugagaaaacccacccuuucuuccuugauuguguaacauuuauauaucagagcaaucacaaguugccaaucugcuucuaggguaugaaaaggaaguuuuaucuuauguauccacauggcaaagagcccccaaaucugucaccuccaaaauggaagucucuuuuaccauuucuaaggccaagugagcaagaaaaagucaugauuaaugucaucauggaaaauugccccauauccaagaguaaauucaaagauuacugagggauuuuucucuaagaaaauaaauaaauaaccaucaucagggcaaucaucuacaaaacuugguuuagaaauaaauuuuuaggccggacuuuuaggccagacacagcggcucacgcuuguaaucccagcauuugggaggcugacguaggcaaucacuugaggucaggaauucgagaccaaguuggccaacauggugaaacccugucuccacuaaaaauacaaaaauuagccaggcaugguggcgcacaccuguaaucccagcuacucaggaggcugaggcaggagaaucacuugaaccugagagguggggguugcagugagcugagaucgcacgcaccacugcacuccaaccugggccacagagugagacuccaucucaaaauaaauuuuuaggcugagggcgguggcucaugccucuaauccuagcacucugggaggcugaagugggaggauuugcuugagcccagcaguucaaauccagccugggcaacauggcaaaaccuugucucuacaaaaaauacaaaaauuagccaggcauggcggcacaugacuguagucccagauacucaggaggcugaggcgggaggauagcuugagccugggacgugaaggcugcaguaagcuaugaucaugcuacuguauuccagccugggugacacagcaauaucccgucucaaaaaauaaaauaaaauaaaauaaaauaaaaaguuagaagaaauuacaagucaaauucaacuccugguuauacuggaccauccaaaaccagguauaaagucucccuggucaaaguaggcuuuucggggccagauuucaagcuagcugaguucauaccaucccaucuaguccuucauuuccugugggugggaucgcucauccuccuucucaggaggccacagucaccacuguauccgcugcuaaguggucaccucccuccggggccugccuucuuccagagaaagucugaggccauuuuuaagugccccuaagcacgcagauccugaacuccaauuucauccuuauggcucaaauaugguccuaucgcuuacucuuacgcucuaagcuuggggaauaaaagggacucaggcucucauggagaacacacuuccuuuagugaggacuuucaggguauauucaagcuuucacaacacagagaaagaacccaacuuugagauaucaggaagacguguucccccgcccccccaaauaaauacuuugcugaguagcaguauuggaaauuaauccaggaaauuuuuuaacuacguaugcaguacauuugucuggacaucaacaaguccguaugaaaccacaauaaugacuauaaaaagaagaaucuggcaaaaugauacuacaaauagauuacugacaauaaauggagugugagccuacuuuguauaaucacagaauaacagaucugaaaaacauucagucuuagggauuuaaaacuuucugcucugauuucaaaggauguuguuccuaauaguauauaccaggcccaguggcuucucaucaacaaaugcaauuaguuuugcaacagucucuaacccaagauauggaaguucuugcaaugaauuugaaaagauucuaauuuagaauuuggggaauuuuuuuuuuuuaagauggaguuuugcccuguugcccaggcuggagugcacuggagugaucucggcucacugcaaccuccaccucccggguucaagcgcuucuccugccucagcgucccaaguagcugagauuacagauccaugccaacacaauugacuaauuuuuuguaucuuuaguagagacgggguuucaccauguugcccaggcuggucucgaaccccugaccuccugauccgcccgccuuggcuucccaaagugcugggauuagaggcgugagccaccgcacccggcuggaaaauuuuuuuuaaaucuucuaccacagucacauauaguucugaagcuacgauuuagaaguguuaaaaauucuguuuugagaaagucaacagauuuaucaacauuaaagaaauuuguguaugucaaaacuacuguaaauauauaaagcaaagauaaaaugggaaaaguaucugcaauaugaauggcaaagauuuacuaucaauccauaaaaggcucuuaugaauuaauggaaaaauacuaauaucccaggagaaaaaucuggcacuacaucaaauuucaaaauggaaaacaacuagauuucuuugguguucaaaucaucuguaaucaaagaaauugaaguuuaaauauagagaaagcacuguucaccuauaaaccugggaagaauuuuuuuuuuuucccuuuaaggaugauucuacauguugacaagaauacgguaacaccaguauucucacagagagcuggugggaacauaauuugguuaaacauuuuuuggaaagcaaauggucaauauguaugaggagaucuuccaaccaucaacuguauuucaagggcacuaaggauauuaacccugcacauaaaguuuuaaaaacguauuuguugcaaaaguauauuuaguaaguggaaauaaaugaaaaccaguuugauacaucuauguaauguaauauuaaguagccacuaagauuucugaagauuucaugacauggaaaauuuuucaugauacauuaaucaggaaaaaaccuccacgcaauaguauauuuagauaaacuauauaacuauaaaaaauuuuucuauauauuaacaaguauuuucuuaaauauuaacugugauuaucuuugcugaaauugcuuaacucacuuuucucaaucuaccuauuuuuauacagcaagcacggauuacuuuugaaaucaaaacaaacaggguuaacagaacagggcuauuaaguaacaggcuuuuuaaaugcuugaguguaauaacugcagguuaguuuccaaaaaauauaagauauuaucuagaaucuuauaauccuauuauacuccaaaauguaaccuugacuuauugacauaauuaaaaggucuuguuccaagcaugauuuucuaccaagcagauuuaccaagaauuauuuucucuucauaaaccugauuuuaaaaagaacaggugaaaaaacguggugcaaguuacauaaauaacuacauauuauuuuaaacuaaauuccacuucuaagguuuuuuagcuuugguuuuaaggauaagcauguaguucuaaucuuuucuuuguauagcuuuccuaauggaauauauugccuaugaaaaaaaaaaaaucuguaacagcacuuucuacacuguaaagcacuguacuaacaggacaucaccauuuuaaguuguguaucauuuccugcccuaaccaucccugaaaaagcaaacugucuacagaauugcaauuccguuuaugcaauuccuuuuaaaguuguccaugcacuguuaucuuguauauacccuccuuaaagaggucacugguucccaggaagcaaugacucucuuuuuuaauccccucccuccugcauugccucccuuccuccugaaauucacugguaacaccccuacucccacccuccagccccagcgcugugauuuagugaugauugacuuucgaucaccugcaccuggcaaaacuugaaagcuuccacgcaccguuuugccuaagacuuugguuucauugaaacaaacaaaacacacuggauuuccuuucuuagaacacugacuacuucaaacaaacaguauuuaacagaguauguguaacuacgcaggcuaaaugaauuaaccucuuccuuccuagucccaaauuacuccaagucaaaaaucaacaaacaacuugguagaaaggaguacgucuucaaaaaagaacaaaaacguuccucagugaacaccuaaguccacuaagcacuauagaguagucaauaaggucaccuuaauuaagaugagauuuuucuagagcgugaaaaagugcaaacaagcugcagaaaguagcgaggcgccacgaggggucuuugggaccugcagcaacccuauuccacccgcuuucucggccccgcuugcuucugcugagaaggggcccugcgagaaggcugggaccgccgggcccgggugggcggcguaaggaguccacagucaagccccucggucacuuucaaggugacagcgacgagauccgcauccgucccuuccgcaggcucugcgcuggcccacgugagacccgccuccgcuccgccggcgcugccgcccccuuuagcccucagcuucggcccccaggccccuggaacgcccccuccccuccccgaggaccggucccgucacccugggcggcgcgcucgccuguccccuccccaccccggccgccgggcagcgggaacagauuccagcgcgcacuuacccgcagcuccuucaagcgcuccgggagcaaagacgcagaggcggggagggcuggcgcccuuugcaccacuggcggggucgccgagaacccgccccggaggucucgggggcggcgucugcaccugggggcgcgcggcgcggcaccaccccacgccugcggcggcuaccaggcgggaccc

SEQ ID NO: 21444 - RNA, 157948 nt, Homo sapiens
gggucccgccugguagccgccgcaggcgugggguggugccgcgccgcgcgcccccaggugcagacgccgcccccgagaccuccggggcggguucucggcgaccccgccaguggugcaaagggcgccagcccuccccgccucugcgucuuugcucccggagcgcuugaaggagcugcggguaagugcgcgcuggaaucuguucccgcugcccggcggccgggguggggaggggacaggcgagcgcgccgcccagggugacgggaccgguccucggggaggggagggggcguuccaggggccugggggccgaagcugagggcuaaagggggcggcagcgccggcggagcggaggcgggucucacgugggccagcgcagagccugcggaagggacggaugcggaucucgucgcugucaccuugaaagugaccgaggggcuugacuguggacuccuuacgccgcccacccgggcccggcggucccagccuucucgcagggccccuucucagcagaagcaagcggggccgagaaagcggguggaauaggguugcugcaggucccaaagaccccucguggcgccucgcuacuuucugcagcuuguuugcacuuuuucacgcucuagaaaaaucucaucuuaauuaaggugaccuuauugacuacucuauagugcuuaguggacuuagguguucacugaggaacguuuuuguucuuuuuugaagacguacuccuuucuaccaaguuguuuguugauuuuugacuuggaguaauuugggacuaggaaggaagagguuaauucauuuagccugcguaguuacacauacucuguuaaauacuguuuguuugaaguagucaguguucuaagaaaggaaauccaguguguuuuguuuguuucaaugaaaccaaagucuuaggcaaaacggugcguggaagcuuucaaguuuugccaggugcaggugaucgaaagucaaucaucacuaaaucacagcgcuggggcuggagggugggaguagggguguuaccagugaauuucaggaggaagggaggcaaugcaggagggaggggauuaaaaaagagagucauugcuuccugggaaccagugaccucuuuaaggaggguauauacaagauaacagugcauggacaacuuuaaaaggaauugcauaaacggaauugcaauucuguagacaguuugcuuuuucagggaugguuagggcaggaaaugauacacaacuuaaaauggugauguccuguuaguacagugcuuuacaguguagaaagugcuguuacagauuuuuuuuuuuucauaggcaauauauuccauuaggaaagcuauacaaagaaaagauuagaacuacaugcuuauccuuaaaaccaaagcuaaaaaaccuuagaaguggaauuuaguuuaaaauaauauguaguuauuuauguaacuugcaccacguuuuuucaccuguucuuuuuaaaaucagguuuaugaagagaaaauaauucuugguaaaucugcuugguagaaaaucaugcuuggaacaagaccuuuuaauuaugucaauaagucaagguuacauuuuggaguauaauaggauuauaagauucuagauaauaucuuauauuuuuuggaaacuaaccugcaguuauuacacucaagcauuuaaaaagccuguuacuuaauagcccuguucuguuaacccuguuuguuuugauuucaaaaguaauccgugcuugcuguauaaaaauagguagauugagaaaagugaguuaagcaauuucagcaaagauaaucacaguuaauauuuaagaaaauacuuguuaauauauagaaaaauuuuuuauaguuauauaguuuaucuaaauauacuauugcguggagguuuuuuccugauuaauguaucaugaaaaauuuuccaugucaugaaaucuucagaaaucuuaguggcuacuuaauauuacauuacauagauguaucaaacugguuuucauuuauuuccacuuacuaaauauacuuuugcaacaaauacguuuuuaaaacuuuaugugcaggguuaauauccuuagugcccuugaaauacaguugaugguuggaagaucuccucauacauauugaccauuugcuuuccaaaaaauguuuaaccaaauuauguucccaccagcucucugugagaauacugguguuaccguauucuugucaacauguagaaucauccuuaaagggaaaaaaaaaaaauucuucccagguuuauaggugaacagugcuuucucuauauuuaaacuucaauuucuuugauuacagaugauuugaacaccaaagaaaucuaguuguuuuccauuuugaaauuugauguagugccagauuuuucuccugggauauuaguauuuuuccauuaauucauaagagccuuuuauggauugauaguaaaucuuugccauucauauugcagauacuuuucccauuuuaucuuugcuuuauauauuuacaguaguuuugacauacacaaauuucuuuaauguugauaaaucuguugacuuucucaaaacagaauuuuuaacacuucuaaaucguagcuucagaacuauaugugacugugguagaagauuuaaaaaaaauuuuccagccgggugcgguggcucacgccucuaaucccagcacuuugggaagccaaggcgggcggaucaggaggucagggguucgagaccagccugggcaacauggugaaaccccgucucuacuaaagauacaaaaaauuagucaauuguguuggcauggaucuguaaucucagcuacuugggacgcugaggcaggagaagcgcuugaacccgggagguggagguugcagugagccgagaucacuccagugcacuccagccugggcaacagggcaaaacuccaucuuaaaaaaaaaaaauuccccaaauucuaaauuagaaucuuuucaaauucauugcaagaacuuccauaucuuggguuagagacuguugcaaaacuaauugcauuuguugaugagaagccacugggccugguauauacuauuaggaacaacauccuuugaaaucagagcagaaaguuuuaaaucccuaagacugaauguuuuucagaucuguuauucugugauuauacaaaguaggcucacacuccauuuauugucaguaaucuauuuguaguaucauuuugccagauucuucuuuuuauagucauuauugugguuucauacggacuuguugauguccagacaaauguacugcauacguaguuaaaaaauuuccuggauuaauuuccaauacugcuacucagcaaaguauuuauuugggggggcgggggaacacgucuuccugauaucucaaaguuggguucuuucucuguguugugaaagcuugaauauacccugaaaguccucacuaaaggaaguguguucuccaugagagccugagucccuuuuauuccccaagcuuagagcguaagaguaagcgauaggaccauauuugagccauaaggaugaaauuggaguucaggaucugcgugcuuaggggcacuuaaaaauggccucagacuuucucuggaagaaggcaggccccggagggaggugaccacuuagcagcggauacaguggugacuguggccuccugagaaggaggaugagcgaucccacccacaggaaaugaaggacuagaugggaugguaugaacucagcuagcuugaaaucuggccccgaaaagccuacuuugaccagggagacuuuauaccugguuuuggaugguccaguauaaccaggaguugaauuugacuuguaauuucuucuaacuuuuuauuuuauuuuauuuuauuuuauuuuuugagacgggauauugcugugucacccaggcuggaauacaguagcaugaucauagcuuacugcagccuucacgucccaggcucaagcuauccucccgccucagccuccugaguaucugggacuacagucaugugccgccaugccuggcuaauuuuuguauuuuuuguagagacaagguuuugccauguugcccaggcuggauuugaacugcugggcucaagcaaauccucccacuucagccucccagagugcuaggauuagaggcaugagccaccgcccucagccuaaaaauuuauuuugagauggagucucacucuguggcccagguuggagugcaguggugcgugcgaucucagcucacugcaacccccaccucucagguucaagugauucuccugccucagccuccugaguagcugggauuacaggugugcgccaccaugccuggcuaauuuuuguauuuuuaguggagacaggguuucaccauguuggccaacuuggucucgaauuccugaccucaagugauugccuacgucagccucccaaaugcugggauuacaagcgugagccgcugugucuggccuaaaaguccggccuaaaaauuuauuucuaaaccaaguuuuguagaugauugcccugaugaugguuauuuauuuauuuucuuagagaaaaaucccucaguaaucuuugaauuuacucuuggauauggggcaauuuuccaugaugacauuaaucaugacuuuuucuugcucacuuggccuuagaaaugguaaaagagacuuccauuuuggaggugacagauuugggggcucuuugccauguggauacauaagauaaaacuuccuuuucauacccuagaagcagauuggcaacuugugauugcucugauauauaaauguuacacaaucaaggaagaaaggguggguuuucucaacaaguuuagagugugaacaaggucgaacuuggaagugcuucacuuaaguaaauagcuuucagguacuuuagaaguacguauuugcauauaaaucuugauuacaaaauaacuuuguucauuaaaguuuagacuucaagcuguauauuguaaaguaauaaaaauguauuuauucaaagauaaacugcauuuaaaucuugcuagcaggcccauaucuaaaguaagaauguucuuggggcugggcgugguggcucauuguaaucccagcacuuugggaggccaagccaagcggaucacuucaggucaggaguucuagacuacccuggccaacauagugaaaccccaucucuacuaaaaauacaaaaaauuagcugggugugguggugggcgccuguaaucccagcuacucaggaggcugaggcaggagaauuccuugaauccaggaggcggagguugcagugagcugagaucgcuccacugcccuccagccuggccaacagagugagacuuugucuccaaaagaaaaacagaaaaaaagaauguucuugggccuggcucaguggcucacaccuguaaucccagcaauuugggaggccaaggcagguggaucaccugaggucaggaguuugagaccagcuuggcuaacauggugaaacccgacucuacuaaaaauacaaaaguagcuggugugguggugggugcuuauauccccgcuacgugggaggcugaggcaggagaaucacuugaacccgggaggcggagguugcagugagccgagaucgcaucacugcccucuagccugggugacagaguaagacucugucuaaaaaggaauaaaaggaauauucuuguauacacauuagcuacauaaauaaaaguaagaaaaacacacauuuuacccucauucuaaccuagaagcuuuauugcuaggacacagugugaacucaucuaaagggaagaacagacuaggaauggaucagucuuucagguaagauguauuggaagagguuuuuaaaccauuaaaugaccuuauucuuuuaaaugcauaaauguguaccuuauaaguaaauugugucuuaagcaugaugcagaagaaaagaaaauuaguauuuaaauuugaggacuaaucaaauauaauuauucugaucuucuacuguuaacuaaaacauuuaaggacauuuuguguccuaaaaugacauugaaaagggaaucuugggaaagacucauacuuaucaggagacuaggaagaagaggcguaacauacauucuuguguaaauaauguuugugacaguguucauuaagucuugacuguuggguaguuagcuuaucuuuuaugcuuuuuguacauuggaaacaugguaauauuuaacucagguguuauuuacacauauaccaaucuggaugaaaagaaucaauauuucuucaccuuauuucagauaagcaguucauaggagguauucagcaguguucagugacaaauaagaaauuuauuuuccuuaauguuuauuuuguagauuuuugcaugauuguuagcuaugaaugauacgaaguugaaacugcauguccucguaaaacauagcucccuuggcuagcuuuacggaaugaaaauagaagccagcauagauaugagcaguuucugagaugacauugaaacauagaccuacccccuuccccugaccucugugucaaggugguugagucauauuucccagaauucugauuaagucaccuugcacuguuaaaaucuuauuuuuuauuauacuguaaacugcuauacuguuaaucauuucguuguuaaucaaauuacagaauugaaccauauuugcuuauuacugugacccuaagccaacaggcuuuaauugaagugaggauugcagaaguccuccuugcuggugggucaggauaggguagaaggauauuggagaaugagaaauggauuuaaaagggcugagccaugccaagaccuagcuaccaagaaaaauucacguguuguauuagauccccaaucuaggccccacauacagaaccaagucauuuauacguaguguauaguuaggcuuauauuucauguaaaaugauaaauaaaaagcaugaguaaaaauccuugcuguuagaauauuauguuugauuuuuuuuucuuuuaucuuuuuuuuugagacagaguuuugcucuuguugcccaggcuggagugcaguggcgugaucuuggcucacugcaguguccgccuccuggguucaagcgauucuccugccucagcuuucugaguagcugggauuacaggcaugcaccaccacgcccgucuucauuuuuuauuuuuaguagagacaggguuucaccauguugaucaggcuggucucgaacuccugaccucaggugauccaccggccuuggccucccaaagugcugggacuacagacgugagccacugugcccggccuguguuugguuuuccucagccucagccauuuuugagcacuuucuaugggccaaacacugagguagaagagaaaaaaaagaauuugaccucuuuucuuggaggagucagagaaaccccaaucauugugaaaagugcaguuuuggagauguuaguaaguguuuguguuguucgaaauauucucccagguuguuaacguugggcuuugcauuaaaaauuccaccugcugacuugaccaaaguuuggucacguagguuguauugacauucuugguuauauaaagcauccuugucauuaaucaugcuuacccuuuuccuucucaccaaaaggauuaagaaggaaaauacuuagcacuguacucuuuggcgucucuuaauuucucucaaugagaaucuuuaguuaccuuuuccaguauauuuuugcuacaucuuguaagcuccuuaaggauagggucuaaauguucggaugcuggguacauuuuuacuuuuauaauuauuucucccagauguggucuggaauaaaucaucuagagcucugauggcaugggaauuugaaauucuuuugucagauagucacagcuacuggaaggucuuuuaaaccacagguauuaauuuccuuauugcuuuucugugccuugcuccuugcccucuccucuugcccucacccccucauccauuguuucauacucagcaagcagagggaagguaguuuacccucagucuuguguccgacugaacggccauggcuuugggagcagagcaucagagcuggaaggugccaaguuuccugaugcuucugaguuacuguuuuauuaugaagagucaguuugagaacaucuggcauacccaugugcaaauacauguacguaauugauuccacucaugauuuaugacauucccuauucgugcagacaaucgcaaguugacaauuucuuuugacuagggacuugggcuguuuucuguuuagagaaaaauguauguacaacuuaggaauucagauaacuuugcagucuaggauucuuuuuucucauuacaucuaauaagauuuguguuucagaguaguuuugcauuuauguaaaacuuuucaauaguucucuagacuugcugguuauugaacuugauuuaaugcugugaagaaguauuuucuguuuaaggguuaaaaaauuguuuugcuuucagauuuuuuuugagacagagucuugcugugucacaggcuggaggacaguggugugaucucggcucacugcaaccuccgccucccagguuuaagugauucucaugccauagccuucugaguaccuggcacuacagguaugcgccaccgcgccuggauaauuuuuguauuuuugguagagacagaauuuccccauguuggccaggcugguggcaaucuccuggccucaggcgaucuguccaccuuguccuuccaaagugcugggauuacaggcguaagccaccaugcccagccuucugauguugcuuuauaguguuuuugauggcaccucugcaaagggauuuacuuacucuuaauuugaauuuaaaagaguagggucaguuaaugaaaagggagguaagaaaaauccuacauuucuguuucuaugagaaaaccuaaaccauuuuauauugcagauaagacuauuuuguuggaaaguucugguuacagcuuauuaggcugaacauuuaaaaauguauaaccuuguagauauauaaucaaaugaaaacuauuuucuccuuauauggugugaguuguuuugaucuugaaugauuagcccuccauccuucagugcuagggacugcuuuucuucucuccuuccuccuguuuuuauugaauuucaaauaauaaauagagguauuucaccauuuagcuagauuuugcccaccaugacauccauuaugaaacccuggggacauacuuuauuauagaauuggaaaaauguaauggguauccaggacauuuggugcaguaaugucauagagagugcacagacuuaacaggcaaaauuggguucaugucugagauuuuccuauuagccaugugaccuugagugaaauuucauuaccuuugcuccccaguuggcucaucaggacgcuggaagguggggguaguaccuugucuccugggguuauucugacacaggugccagguauauagaaaaugaucaaugggugcuaauaaccuuccuuagucucuaguuuuaaauuaaaucuucugauucauagauagguguuucauuuaauuucugcugcuuagccuuggagguguugcuuggaucugcuggugcugucgguugggaguuaaauucuaggcucaggaggcugauaacuuucccucuuccuuaggaggaauugauuuguagcaaacauuggagauuguuuauucucagacuccagcuuugucaccucuuguuuuucuugaaaguuuaagucuagugagcugcugauacuccauuugaacuguguuuucaaaaaaucaauguagauacuuuuaucuuugguaaagucuguaaauuauguugccucuuugcuaucagucagcacauucgaaagacaauugagucaucacuuugaacuaaucuuggacuuguggauauuacaguacuaagguucccuguucugauuuuucaccuguaacauaguccagaauauuuguauuuuagaguuucaauuguaaaauguuacuauuaauauacaguauuuaaauauaaaagcaauuuuguauuuucaucuuuuaagcauagugaaauauuaauucccuauguuuguggcaagcacauuguaaauaugauauuaagaacugaucacaucagcccugcgguugggcagagcaggucaugagugcuuucuuuuauacugaaggagacuggggaccagaacuauuuggauaaauguuuugucuuauggcgaguaaguuauggaacugggacuggacuuguaccgguccauuucccacacccaguaugaugcuguuauuugacuaguuuuaaugcgaguggaaguaauaaguuucuguugccaggauuuucuauacauuggugcugaaaugggauaaaacuucuccccgcccccaccgauaguuugcuuugucacccagguuggagugcagugguacgauccggcugacugcaaccuccaccucccggauucaagcgauucuccugccucagcuuccuggguagcugggauuacaggugccugccaucaugcccggcuaauuuuuguauuuuugauagagauggaguuucaccauguaggccacgcuggucucgaacucuugaccucaagugauccaccugccuuggccucccgaagugcugggauuauaggaguaagccacugugccaggccaagucaugcaguaguuaugauauguaaaauuucaaaugacauagcugagaauuacgguuuauuuucacauuuucuaaucacagaacguaaagccgaauguuaaauguuguaagccauucagauuaguagcacaagugaaaaauugacaguuagagaucauuacaaucaugaauuccacuuacauaggacuuuauagcuuucagacugcuuuuugcaauaaguccuaauagaacuguauagaaacaaucauuugaauaauuagauuuuuuguaucucacuucauagauuagcagucuguggucuuauaugcuggauagcaacuacuauuuuuuuuccugaaacuuuuuuuuuuuuuuugaaagggaaucuugcucugucacccaggcuggagugcaauggcuucaucucggcucauggcaaccucugccucccggguucaagcaguucuccuaccucagccucccgaguagcugggacuacaggugugugccaucaugucuggcuaauuuuuuguauuuuuauuagagguggggcuucaccauguuagccaggauggucuugauuuccugaucuugugauccaccugccucaaccucccaaagugcugggauuacaggugugagccaccgugcccaguugaaacuuuuuuuaaaaguagaaaucuugaauucuguuuccuuauuguaagcuacugagcggcagguaauuaguggaggaaauggagguaaucccagauggaaacugaaguaggaggugaggccagugucagaacugggaagagacgaaugcccucacaaaaccacaguuucagcugaauaucagucaugauuuuuagcccuaaaagucaucaguucucuauuuccaaauugucuucuaaggaauauauaggguuaggacuguauaaauaggcccugguuggagguuggcuaucguugggcugcugcugugaguuaaauguguauauacagucaccuucuguuaaagaacucuugcuagcagaaagccuaacauagguaaucauuuucaagaaaagggugcaggaagucgauguuuaauaaagguugggagguauaaggugaggugccaacuugcguaacuacacacacauaaagacauuuuccauuugguguuggcgugauucaaauggaaaauuauuuccuuuucaccaaguggacuuuggagagagaggacaacucugaaguuucuaaacaaggaaauguucauggucauuuaacacuuugggguaaagauuuuauauuucagcuguaaacucugcccugcccacgcgaucuacccccacgucccucaaacagucugagcuaccuuuuagguaguuuuuaaaaacuaacugcauauaauuuaaaaacuaaaaguggccgggggcaguggcugacaccuguaaucccagcacuuugggaggccaaggcgggcagaucaccugagauugggaguuggagaccagccugaccaaauggagaaacccuguaucuacuaaaauuacaaaaguagccaggugagguggcucauuccuguaauccuagcuacuggucaggcugaggcaggagaaucgcuugaaccugggaggcggagguuguggugagcugagaucgugccauugcauuccagccugggcaauaagagugaaacuccgucucaaaaaaaaaaaaagacaacuaaaagcaugcacagucuguacaucaaaucauuucuuuagcauaacuguacagucuuugagagugccuuugauaagcccuggggguagauggugcuuuuaauuauuuacuucuauacaaacagcucauuguauaaaaguaaauacuuuggacccaguacuauccugaaacuuacuguuuugccucuuguucuuuuuuacugauuuucaugacaaagguuacuuucugauggaauuuugaaaaucaucuacaauaugaugugauaucuaagagagcaagggcuuuauuuuguuccuuccucugggaggaguauuuagaauugugcuuuuuauuuuuguucaauaaacuguugaaggaauguugacuuagauugagaaauauaguugagauucucagaagucggcugaguuaggacugcaggcagcuggcacaugauccuuccuagccugcuuuucaagguggugguuuagucuguggcugucguacccuacuggguuguggacagagaccuacuucaguggaagguucuagaugaauauguucaggauguaacaguaaaacaugaaauucugaguaaagagacagaaacgguaacuaguagcuaucgucaacauuuaaggguuucuguuggguaggaaggauuaguuggcaagcagauuacagaaaaagaaugcggaaaaaaucuguagauuccaauaagaauucaugaauaugucucagaauacacacugcuguucacuaccacaugaucuuugaaacaauuuuugagauaacauuaagugugaugaaaugcagugcaccuggcuuaagugugcaauuauaugaguuuugacaaauacauauugguguaacgaucacaccaaucaagauacagaauguguccaucaccuuagaaugucuuuuuuuuuuugagauggaguuuugcucuuguugcccaggcuggagugcaagggcacgaucucggcucacugcaaccucugccuccuggguuccagccauucuccuacuucagccuccggaguagcugggauuacaggcacccaccaccacgcccagcuaauuuuuuguauuuuuagugcaggugggguuucaccauguuggccaggcuggucuugaacuccuuacucaggugauccgccugccucggccucccgaagugcugggauuacagugugagccacugugcccagccagaaagucuucgugacuggaugaauaaacuauugagcuuuggucaucagaaaagugaggaugauaauaaggcuuguuuuacaagguuguuggcauaacaguagcaauguacaauuguguauuagaaaguuuccaaaaauuuuauuuaacucuaaaacgacccuaugagauggauuguugaaucaguuuuuguccaugaggaaaaugaggcgaagaauauuuuuggcuuguaacagguaacccaguuccugagucaguuuaggagcuccuugauaaacguaugcuucucauaucagguggcuauaagguccauagcugugcagaccuaccagguguuuaggugauuucguuauugugagaaggaagguggaaauagaucaagauuacacauuggaguagaguuuaauguccauugcugcuauuuauuaacucuguguuuugagcaagguacucaacuucuggaaacaucagguuuagcaucucagaggaggagggaugggggaaugugacugucaugugaccugucugucacaugggacugucuacugggaggaugacugugggaacacuguggacuuugaagagcugugcacugaugucguuaucuuuacccaugcuggaggcuguggccuguuccucauccuggccucacaaacugugcuggccuggcguggagcaguggaauugacagggugucagggagcgguggccccuccuuggcaguccuuggauuugccaaacacuguguuuacacagcgcuuucucucaccagcccuuaugauguccugaagcuuccgaucgcuuuucagcaaugaggucagccucacuccacaaugcuugucaaguguacuaggaaagagucuuuuuuaaaaauucaacuuuuauuuucuuucugaaauguauagcugugauacaaaacaguauaugcugguuugagguggaagaguucauaagggauccgaagaacugauguacuguggccugagcgaaagucucuugugauaaagcgcuaccccugcaguguuaaauguugguuguuaacguagcaccuuaacucuuaauaucacauaugaaacccagcuccuucauaccgcucggguggauccauuucuuccagccccagccagucucucaacuacggaagcaggugggacacuuacacauucacauugugaccccaaauggaacuuuauuucuuuauaacccaacugccucacacauccucauuucaccucacuuguagagaacauauaauguggcaaccucaagauaacucaguguuuuuugguuucaaagagucgcuugcagauaaauaucuccuugaggauuuuaaguguggucaguucacgcuuccuaucugaggcucuucucuccucugaaggauggauuuccuccuuccucagcggcucacccacuucugagauggugccuggguccuugaagagcuuuuaucugagauggugccuggguccuggaggagguuuuagcaucauggcagcgggugaggacugucugcugccaggcacugccuuccagaccucucuggucucuacggaaguaacucaucgggcuuggucuuugggugccucuguccuaggcucgugcguguguuggugauguggcuuccauugcaagaagggucagaauacacugaccuuccuugacguguucuaagcugcuuuuuuuuguuuguuuuuuccagagauggggucucgcucugucacccaggcuggagugcuuuggcacagucuuggcucacggcagccucuaacuucugggcugaagugauccucuggugucagccuccugaguagcugggacuaugggcaugugccaccauggcuggcuaauuuuuaaauuuuuuagggacagagucucacugugucgcccgggcuggucuugaacuggguucaauagauucucuuguuuuggccucccaaagugccgugauuacaggcaugacccaugguaccuggccuuaggccuuugcugauccaucggcccucucaguacuucccuugguguauuucuuucucuccuggucuguugcuuugaucuuugcagaggugagaaacugcccuccagaucugccuuugucaucuagaucagagguuccaaaugugcaucugugacccugggguaccuggugacagaauguugacuugaacacggugagauggaauaaaaauacaguguaccaagauuuucauaaggcuaaauguauauuacguaaacuaaaggaauguucuuuaugcugcaguuuuguaccccuuucacuuuuuguauuaaaauaauguccuuuuaugauguguuggcagucguacaaauuuugucugaagugccccucuuggcaaaauuaaagcugacauccccaugcugucucugcagaguuuuggaguguggaugucacagguccauaaaaucugaaaggcugagaagcacucaccugccuaugccuuagucucagcucaagcuuuaucuucuucuggaagugacauuucacuguuuucuccauaucuguaacaguggagccuauucucugggucccuuuagccuccagucgcuucuaccuuugcaguuuuuguaauuauuuacuuguacauuuuugucuuccuggcugaacuggaggcucuuuggaggcucuuugaaggcugggaccaucuuguucagcauuguguccccaucaccuagcaaagaagcugcaugugauagaggaccuaggaauguuuguugcaugaauaaaaguucuuguuauagguggggcgcaguggaucacaccuguaaucccagcacuuugggaggccgaggcagguggaucacuugaggccaggaguucaagaccagccuggccaacauggugaaaccccguuucuacaaaaaauacaaaaauuagccggacaugguggugcacacuuauaaucccagcuacucaggcagcugaggcccgagaaucacuugaagccgggaggcggagguugcagugagccaagauugcaccacuguacuccagccugggugauagagcaagccucugugucaaaaaaaaaaaaaguucuucuuguuauaaaaaggucacucuguaacagggauaaggaagcugacagaguggugugagaaaugcccccauucuguagccacggaacuucucggagacuguucugcaugcuauuguauacauuccucucuuuguagccaguuggaacucaaucguaaaaauuacacagggaucauuucauucuugaaagucucuuaauaugguggcucaugccuguaaucccaauacuuugggaggccgaggcaggcagaucaccugagauuaggaguucaaaaccagccuggccaauauggugauacuucaucuccacuaaaaauacagaauuagccgggcaugguggugcgcaccuguaaucccagcuaccugagaggcugaggcuggagaaucacuucaaugugggagguggagguugcagugagccgagauggcgacauugcacucuagccugggcaacaagagugaaauuccaucucaaaaaaaaaaaaaaaaacaguuguaagaaaauuagcaggguuuagauugccaacuaaaacaucuuacacugauguaacagcagggaguaggaguauucucaacuguaaauguggauucaguuaaaccacacugccauuuugccuauaacggcuaagcuauaggaaguuaguaucaaaaggagagauguuauuuuauuuaacuuaugauuacuuuaugaagaguugaaaucauuuggagaaaggcaugaauggauacugaauuauuugcuuuuaaaacguuugggggcuguugaauuccacaaaucucaauugggugaguguggguagaacauuucucugccaucuuucaguggaaaucuucauugcauucaucucugccuuuaagcucugagugaccuucaugucaucggggcccauaggucuuugggaauuggaguggugguccgggccacugucagugguauuuguugaccacagcagagccucagauugccguuaaggauggagucugcauguuacugaauuguuuuuugagaaauuacugcuggggguacuuaguuggugucugucuugcuugagcuucagauaccagugauuguaaaggcugucaccaauaggcugucaggcccuuggaagucagacucaaggaccgucuucauggagccucaggcugaguugaacacaguagccacagggauacaaagcuaaacaaugcccaacuugugaauuuccacauucuucucauagcacaacagcaugcgcauugcauaucuuuuuauuuaaaaaaaaaauuacaucaucuccuccuccaugucuagugaggacagauucuaaggccugguaugcucccucuuccuacacucccaucuaagaaaggcaaauagcggccaguccuggagugcugagacuuuguucugcuuaugagggcaagagagggaacuuggcugguccauguuguguuccuuuguuuuccuggcacacccccaccuuuagcaguguuuggaaaauuccaacuccagaauggauggaauggagagaacaccucacucaccuucacagccagagacuucacugggcaggugcuuauugucagagcuaggaccagugagcaaaucgucuuuauuucuuggagcuguagcucagagucaagccagguugccuucucaaauacaagggccaacauguuauccucauugcguucuuaagggcguguguguguuuguuuguuuguuuugagacagaauuucacucucuucgcccagguuggagugcaauggcacgaucuuggcucacugcaaacuccgccucccagguuuaagcgauucuccugccucagccuccugaguagcugggauuacaggcgcccacuaccacacccggcuaauuuuuguauuuuuaguaaaggugggguuucaccauguuggccaggcuggucccgaacuccugacuucaggugauccacccaccucugucucccaaagugcugggauuauaggugugagcuaccaugcccggccagguuucauaaggucuucauuuaauguugccaguagaaaccugggaaugaaacauuuuuuacacuguagacuugugguuucagaaaagauguuacaauucuuuacaaaauccaaguuagggauaaagaaaagggaucaguuuugaugucaugauggccuuggaggaaaggugugauaugaaauacauaaauguauuuucucuguauuuuuggauguacucucccauaaaacuucacuguuaaaacauuuaaaccuaauuugagggucuuaugcuucauuuuaauagugagauggaaaaaccaaucaaauauuuaucuugaauuuguaguucuuaaaauucaaguuauuauagucuuguuuccuagaggcguagcagaagauaauguauaguuuuaggaucagguguauaguaucucugguagaccuuuuccaauuagaaaugauacaguauaugguuaugucuauaaauagcacaagggaauauuuaacuuacuacaucaucuugguaugcugugcuuuuuuugaaaagugacuaacauuuucuuugaauauuuuuaucaauaccuuuucccaaagcuguuacacacaucugaaaucucacuguuaugaauggacaugacauuuaaggggggaaaaaaaucccaucauugaguuguuugaaauuuccuggcuaaaauccauguaugaguaguauaucugugucagcuuugauuuguuagccccauaaaaccacggacuugcccauuugaaaugggagcccagccuugggucuggccaaccgagggccaucagguuagagggcgcuguccuuggagggccuuuauagcacuuaggaccugagacuugcuguguuagcaguggaguguugcuaaucccacagggaccugccuggcuucugaaggguuucucucuaaaggcggccucaugauuaucuagggccaagucaggaaucagaggggcugccagcccaaaaauagccacagccuacaaagagggaccucauggcacagagccaccacugccuuccugaugccagagguugaucacaugaugggggcaggaggccgucgagcaggaaaggggugcugucuaaagacagguguggccagugcaggggagagccagcauuucuucuuggcguguguagggggagguuaaagucuuagugguugauuuaaaaaauuuuagaaaugaaaguaaauauugaaguuagucauuuuaugaggcuaggcuuacugggauauguuucuggauaauucuaauuuguaagaaacucuuguguuuaauauuaaucacugucauucagaggaaucgaaacaguaacaugucuuguuuccuuauacugccuuugaacacaaagugaagccuuguuucaaaacuugcagacaacaggccauuuaaacaaagacuacacauuuuaaguugaaauuuaggggaggauuauuuaacauucuuacuaauaacucuuugguuacaaugugguacaaauuguauguugaagucauaugggcuggaagaaacuuugauuggaaauucagacaaaaucuuuucagaaugguaguuguuugcugauuggcuaugagauauuugaaacguaguauuucuuuuagagacuccuuuguuccauuuuagguggaaacagaucacuugagaaguugugcaaguaaauaauccguggucaaaaacaggcacacucuuauuccuugaagccuucaggguacuuauggagaucugauuagauaagaggauaauucuguuugcacaccuguugauuuaggggugaaaugucauugaguuuccuagauucuuccacagccccucaggauugacuaugaaguguaagcugugucaucugauuugucauggcagugagcacucccuuaccuucgaugaugccucacgucaccuuuugcauaaagguuagucuguugcuaauuauugucuuaggucacugggucccuuuuuuguauuagaugugauaggaggccauuagaaggcuuggacugaggaauggcaggaacugaguacaauucagaaggaugacucugguugcuguuuugagaauauauuguaaggaggcagaggcucaugauuugaccaguuaguagucccagagagagacagugguggcuuggaccugggauaauagugaaggugaggaaugcuugcuuuugaaauguauuuugaaggcagugccugucggaguugcuacuggggagagagggaaagaggcagauuauugcugacuccuagguuuuuggcuugagguauauucauggugucuuuuguugaaaaccaggaacacuaggacaagaaggaaaugggcaggggucuggaagcccagaguucccuuuuagacuugaagcuugagauuguaucagacuguucuugcauugcuagauugaaauacccgaggcuggguaauguauaaagaaaagagguuuaauuggcucaugguugugcaggaagcauguugcuggcaugugcuucugaugaggccgcaggcagcuuccaaucauggcagaaggcagcaggaaucugucaugucacauggugagagcaagagcaaggggacgggggagguaccacacuuuuuuuuuuggcugucccuuguggagcagggcaaagccauaggaagugugcccagaguccgcugccacacaguuucaacaaccagauguugcaagaacugacucccucuuguggacagccccaagccauucaugagggauccacccccauaacccagucaucucccaccaggccccaccucaaccacuggggaucacauuucaacaugagauuuggaggggacacacauccaacccaugucagagauuccuguuaaacauguaaguggagaugucacauugacaguugagaauucaaaccuggagcuuuggggaaagaucagugcuagagaugaguaugugggaauuguuaucggaguguauuugaaacaagagugagugaaggaagagaaggaauaaggggcugcccccgcccccccuccaacacuuggauguugaucaaagaagaaucucuuagaggcauuugccaaagagaagucugugaguuuaggaggaaaaccaagauagaguagggccucugaagccaagugaagggggccuucuuuaagguugauucccguauugugaagagguuucgauuugucaaacugggaccauuuuuuccaauuuuuggugagagagagagugagugagugucauuaucauuuagaaacguugauaagcuucaggaaaccuuguuaaauaaauaauggcaaauucagccagaaguaagaacaaauacaacaaaucuuuuaaacaccagaacauggguuuuaguuuacccauaggcaaccucauuucagggaaauacauacauguguugaucauuuuugaaauauugacaaggauuggaggaacguacuccuugauggucccugaaauccaaaacacaucauuacgucuccuggucacugucuuuaggcuguuuuaaaaccuucauuuacuagggcuucuuauguaggaggccauaauccuuaucacagcaaaauaguaaacuguaaccacccgucacauguugaaacaguugaguugcuguuaacuacugcuguaaugacacauuuagaaaccuuuccagucucugccuccuuaccuacuacuuauuccuggggucuaagcuugugugacuuguucagagaggccuuccuugaccccuaaucccguaauagcaaucagagcauccaugcuuuccuaugugaccuguaguuuguuuguauaguugugucuauuuuuuugucuauuuuguucacucuguacuagcucauagcagagcauuuggcauuagaugggcacucaguacauuugaugaaugaugaaugucauccaauauuauaaaacagacaccuuacaggugccucaguagcuuugguuuggugucugagcucagugucuucuuuauuuuuauuuuuauauauuuuuggagauagagucuuacucggccacccaggcuggaaugcaguggugcuaucucagcucacugcaaccucccccuccagggcccaaacgauccucccacuucagccucccaaguagcugggacuacaggcacccaccaccacaccuggcuaauuuuuggauuuuuugguagagacaggguuucaccgugcagcucuagaacuccugggcucaagggauccgccugccuccucccuccaaagugcugggauuacaggcgugagccaccacaccugcccuccucuuuaagucugguuuauugagguauaauuuacauauagcagaauuugcacuuuucggguguauaguacaaugaauuuugacaaacaccuguagcugugcaaccaccaaccacacucagcaaaauagauuuucauuauuucaaaguuuccuugugccccuuucagucuuugcccauucuuagacaaacaccaauccuguucccuuagauuugccuuuccagaauauuauauaaauggaguuauagaguauggagacuuuugugugugacgucuuuugcuuagcguauguguuugagauacaucugugugguuuguguaucaaugguuuaccuuucuguuguggagugguauuucaucagaugaauguaccacaauuaaaaaaaaauaaucuacccgugauggacauuuggguuauuucaaguuuuuggcaauuagauuuuucuuccuaguuuaauaacacaggcaagauaauaaaauggcaucagugacccacagcuccauacccccacccacaucuguuuuuguuuuccuguguugcuuuuucuacauauuuuacauagcaggaaucauaaaacacaaaaauauuuuuccuaguuuuguaaacugcauaauuuauaaauaguugcauuuuauugaaucacuguacugugguuuucuaauuccuucuugucaacauuuucaucauuucuaagucuucacagauguggaaaauauacugaaaaucugcugaaauauuuccuauaauaaauuucugacgauaguuuucuugagacucuuaauggaaagucauaaaaauucaagcaaauagggacaaaaacuggaugggugugauaaggauauggaguccuucuaagaacuuagugucuggcagguucucaggaaccaagucagugaggcaaucuaaccuucacuguuuuucauuucugcuccccuugguauguuggucccauccacgucucuguagagauuugcuuucucugcuuuuggguguguggagaagguggcugaugcacagcgccuggauuuauguuauuuaguuccagggacacacugugccugacaucuuuuuuuuuuuuuuucuuuuucuuuuuuugagacagugucucccucugucacccaagcuggaguacaguggugugaucucaacucacugcagccucugccuccuggguucaagcgauucucuugccucagccuccaaguagcugggauuaccggugugcgccaccaugucuggcuaauuuuuuuuguacuuuuaguagagauggaguuuugccacguuggccaggcuggucucgaacucaugaccucaggugauccaaccaccuugaccucccaaagugcugggguuacaagcaugagccacagugcccggccauagccaccuguuucaaauccaaaugcugggggugggaaaauugcauacuguuagacuuaagugucugcacgagggcuaauucacuaguucauuuaguggaacccaccucagugaguaggaggggcuguguucagagaaaggggguuguuguggacuaagcccacacccagguuuuccauuuuaaguaagauaucaugaaaucaagucuuacagcuguugaaauugcucuccgaaagcgcaauuacaauuaggucuuaaaagaggagagagcccagggaguauuacgcauauauuuccuuaaauuuguauuuagauaggaaaacaguuguuaauagugauuaaauaucacucaucgucaccuaugaguaauguuuaauagcaaggaaaaucuaauuuacagucaacauuuauugaaugcuuucuuuauguaagccuuguaucugagauuuuuuuuuuuuuuuuuuuuuuuuuuuuugagacagagucucacucagucacccaggcuggagugccguggugcagucucaccucacuacaaccuccaccucccgaguucaagugauucugcugccucagccucccaaguagcugggacuacagacaugugccacaaugcccagcucauuuuuguauuuuugguagagacgggguuucaccacguuggccaggcuggugaacuccugagcucaggugauccgcccaccuuggcaucccaaaaugcugggauuacaggccugacugcacugggccucguaugugagacuucuguguauugucuguaggucucugcagggauuguuaccaggaucacccccgcccccaccgucaauaccaaaaucugagaaugccuaaguucguuauauaaaauauuguagucuuugcauauaaaaacacauccuuccauagacuguaaaccaucucuagguuacuuuuaauaccuaauguaagugcuauguaaauacauuuauacuaguuauguuauaguguauuuuguauuguuguuuuuuuuucucccgacuauguucaaucugcaguuggcugacuguaaauacaagcaaguuugaaagaccacucagcaccaugcugcauucuaacugagguuuguuuaacccugcagaaggaccucguuauuaagugggcuuugacugggaauauuccaugaagagguaguugugucauucuuugccugcagaugggaccggcgcugaugcugaauggcuuggcggcccaguaggaaccuaagcaccuugacuucacucugaaaugccugcguagucaugcgacucaguaucgggcugugugucuugucacuuuuauuuuuaggcccccacugggguaacccagguuggccaggcugccucaccaggagacuguaccugagcucuguuugcccagugccugguggccauggguccagauguuuguccuaguaauuuauucuaaacagcuacaucgaaaacaucuuugucagcauacuugcugugguuacuaugauaauuuuacucuucuaugauauaaugucucuuuuaugauaguuaaguuaauagagugagaauuucauugaagauuuuaacaaagaacuugcaaacuuaggaaacuuguucauauguacacauggcugcuuucugugcgaccaucuagcuuagaaaagcuuccaccuggcagguguguagggcgugaugcaugcugucguguagacccuuuacauuugaggauuuagcauuugaggucucagauacucaugaugcagccugaaguuucaggaucccggaggugguacgguauuuuucuccuauucuguagauugggaagguugagguauccaaaggugaagccauuagcucugacucuucuaauuugugguguugcuuuaaaaaaaaaauuaugguaaaauauauauaacaugaaauuuacguuuucaaccauuuuugaguguacgguucaguggcauaaaguacauucacaaaguuguguaacuaucaccaguauuuucagaacuuguucaucaucccacacagaaacuguacccauuuaacaauagcuccccauguuccccugccccagccccugguaaccucgaauugacuuucugucucuauucauuugacuacuccaggugcuuuauguaaguggaaucauccaauauuuguccuuuucugguuuuuuuuuuuuuuuuuuuuuuacuuauaauauuuucaggguucagccauguugcagcauguaacagaauuucauucuuuuuuauggcugaauaauauuccacuguauguauagaucacauuuuguuuauccacucaucugucagugguggccacugacaccuuugaugguguccacuuuuugguuauuguaaauacugcugcugugaacauggauguacagauuucuuggagucucuauuuucugcuuuuggggguauaagaguggaaugcuugaucauauggcaauucuauguuuaucucuuggaggaaccacagaauuguuuuccauagcugcugcaccacuugacauuuccaccagcaacgcaaggggguuccaauuucuccauauccucaccagcauuuugaucauagguguccuaacgaguaugaagugguaucugauugugguuuugauuugcaucucgcuaaagacuaaugauguugagcaucuucucaugagauucaccccaaugccugguggcaucaccuccgcuuccuuuucuucacauuuuagaaagggguaaacuuacuuucauuuucuuccccaguccuuauccucuucugauuugagacugaggugguacuagccagaaucaaguaggaaaagcaacaccuuuguuucuuuuagacacauggaaacaaaguccuaacugguguucagcuguuuggcguuuaugcagaugugaagggcuaguguuuucccaaacuaguaguagcugcauugugguuuaaauggguuucagauuggaggccagccugggagcuucuuaacagaaugcuauuaagagagaaaugcuguuaguagcguuuaucuaggaaaacgagcuuuaaguuaaauaaaucuccaggcaaacuuuggaagauuauaugcuuguggguuggggacugccuuuaccagcaggauuguuaaggucauauaaugaggugagggagcuaaaggagagaauguagaugugagggcugcacaguggggaagaacauggacguuggaaugguuaggugugccuccuagucuuauuuuuauauagugugcugugggcccuggcuuccaccucagaaaugcuagucauugauccaugcauguguagaucuguguccaagcugguugacauagacaggagugaugagggacaugucaagaguucuuccuggaaagacccugugggauuuuggugcuccauugcuaugauuugaaugugacucccaaauuuuauauguuuggagguggagucuuugggagguaauuagauuuagauaauuucaucagguguggaccccaugaugggacugguggcuuccuaagaagagagaccugagcuggcaggcucuuacugucucacuaugugaugcccuucuccauguuaugacacagcaagaugguccuuaccagacaccaguuuuguguucuuggacucuaagccugcagaacccugagcuaaaugaacuuugauggcuuauaaguuacccagucuaugguguagcaacagaaaacauaguaacauauacaucaaagugagguaucuuacccuagauuugccuuuauguaggaaagccauugauauagacacugggcuuuuuggcuuguuucagguaaccccagagcaucucuaggccaccucuaaugacaguguggcuagcaugacucuugaagacucuuccccugcuccugcacuacguauggugaucugagacguugcaaaauauuuaaaaaauucgguucagagacauugauuugcagugauguuuaauacagucuuuuauuuuccuuggggcucugauuccuaaucuuuuuauuuuacuguauaucuuuuuuccucuuggauccucucuggcauaacaggaguaaagagaaauaauaguccuucagccuaaauuaacaucucaucccaacuaggugaaagugggggaaaguugugcauguguguauauugcaugaacaauauggaaaggaaggauaauuuaguucauaguaguuuuucuucugaacguaucuuugggaguuuaaucuccuuuugauucucuaauauggauuagucuuguuauauaaucuucaagucuuuuccaugccaguacuuuucaagggcaccuuauguucauaugguuuuuccuuaccuuuuauuccuuuguguguuuuuuuggugcugaauuacaggugauuguuucagaaauuagaagaacuacucuggcuguuuacaaagugaugaucugaaaugcuuuuacuuagugccuagauuuucucuaacauugaaugauaguggguuauaagaagaaguugaacauacuuugucugguuuugggccuaguuucucuuuguaggaaaacuuaaucugcuuugcaacaaccuacuagaguacugaauguacugguuucuuauguuaauugacaucagugauuguagccauaagugcuuccuugguaugacaucaguagagaguacacuggccucuucuacugggaagcaggaccagauaauuauguuuuagcagauauaauaugacagucauaauuaugaaucucuuuaaauccucugugguacagucaguagggauauugaaaacaauagggauucaaguuuggauaaugcgagugaaauauuuauucuuguuuucaccuguagcuuugggacacaaaguauuuaauauaguauaaugguguaggacaucuuuaaauguuucaguuauuuuguuuuguacaugugugucuaguuucuauaggcauuccuuuuaauacauacgauguucugaagguaggauuagucugcaguauucaugccauuucaaggauaaaaauuagaguuuuauccuaaaugcacuuguauuuugcuuucuuucauacauuuaugaggcaagaugaugguaaacuaaaggagaggaaggagauaauucugauccugauucugcuucuaaaucauugugucaucuuaaaagucauccaggccacuacccugcacaauucugggccaccauggccaucaucuuuaauguaaauggaccagugaaguuucuguccauagaauguggugugaauggugacucauagaguuaugcaguagacacuaguagaaaucguaacuucuuuucucuagaucucaguuuucucacauacagaacuaguagauuggguuaaaugaacucagccacuguaaacacuggacgaugaauuauccauguuagucgaucucuuuuccaugaguggacccuguuuaucggaaaauaguaaaauugucuuuguuguaagaguuguauuuaauuucaagagaaucuaucauaggguuuguuuucaugcguagacugccugcuugcaagacuucuuggcaugcauuucaggugucugauucagacaaucuguuguuggaauuugaaagacauuuauuuagggacuacacugacuauuuuguaaaguaacagcuuugaugacacuaguuauucacauugcugagagcagauacgcuggcccaagauucugaauaaaagauuugcagaucuuuuaauugcaaugucugugaaagaaacguugauuugaaaacuucauugcaugaagcauguauuugauuccauuggagcauaaauuuauuuuguuuugauauucaaaauuccaaaaguaauuacaaauauuuaaauaauuauauaaauguauaaaguaaacuuacagugcagcccccugccuccccuuccucaucauugaccugagauggugaaccacugcuaaugagaagguauguaucuuucaggaacuuuuccuuacacagauuauuuuauuuauuauuaacuugauaauuuuugagcagucugaaguuccuaaguuuaaaggauauaacacuccuaagaacuuauugguauagguaauuagucaagggagugagaaguacaauuguagccagauuaauguagguuauuccuuacaucuaaauuccaauuauauuauagaugcauacuuaacaucuuaccuuuaaaacuuuuuuucuuuuucauuauccaaaucacuggaauauuccaguuucuuuaauccagaagcagucacccagccacagugaaugcugauuuaaucugacaggcaaaagugccuucuguuuucagagaugaucugaaaauugcuuaaagaacuugucauguuuuuguuuguuuacaguuuuauugcaagugauguguacaguauaaccaagaaacaucugcguacaaguuuucugccuguaaagccucagaaaagucugugauguuucauuggcagagaguccaaggaaaauucuuuaguuuggaagaauaaaaaagucguuacacucagcccuauuacugcugcaaggcugaacugucuuugaauaaucauaguccccagagaggcuucauuguacggucugguguuuguauuuccuguagucugguugcaguuucugcauugcuccaugaaaaagacagucucugaggugcaaccaaaggcauuaaaaaauuuuguuuggacagauaacucgaauaagacaucucuugcuuaaguugauagcaguugguuuugauauucugaggaauauagguaaguuagcuugguaugguugauuuggggcauuuaaauuaaaaccacucaaguuucaaaagggauuuuuuuuugaagcugcucuuuaaaucuuagaugcuuuccaccugcuuauauuuuguuugugguauuuaucauacuuuauuagauuaccccuacuucaggcuaaauucuagaacguuugaaaaugcuaagaugauuaugcagaaaagugaguauccccuuauguacuuuuuguaaaggauaauaaucaaaugcagggcucugcuuuggguuaaaauaucaaguacaaaaacucucauuaagcaacauguaaaaauguuguauauuauuacaaaugacugugguuauuuuaugguuacaccaacaauuguauggagugcggcaggaaauuauuauguauuauauacuuuauaugucaucugaagugucuagaaccuugcuuauuucucacuuuugcauugugauucugacuguagugcuucccccccaaccccccccguguguguguguguguguguguguguguguguguguguguguguguaagcaaagaguguggcagugggucagagagagaagaaaacugaaacugcuugagugcuuaugauuuaaaaugaucugagcauuuuaauuuggcuuucaugucgucuucacagcaagagaugaggauugagggaaacacaacuuuguuauuucugcugcuuuuaugauauguuuaaagaauauaggaugcccugaaaauguuaaaccauuuuccuuauuaagauuacugacuaagggccgggcgcggguggcucacgccuguaaucccagcacuuugggaggccgaggcggguggaucacgaggucaggagaucgagaccauccuggcuaacgcggugaaaucccgucucuacuaaaaauacaaaaaauuaucugggcgugguggcgggcgccuguagucccagcuacuggggaggcugaggcaggagaauggcgugaacccgggaggcggagcuugcagugagccgagaucgcgccacugcacuccagccugggcgacagagcgagacucugucucaaaaaaaaaaaaaaaaaaauuacugacuaagccuucagaaaugcaguuuuaagaguuugugaauguguaaggucuuccacaugcugguuuggagguuuuaggaaguuguugagccaaaaaaaaaaaaaaaaaaggaauaaaagcauuuuuuggaaugaacuugaggaaucagaauucuugaaccuuagcaggucagugaauugauuuugucuggaaucuuuauacuucccgcaggcuuugcugggagcuucuccuucggggugcugucuuugcuaucaccagcuaggggcuugcuccuccacccccaagcagaggcuuuuuaauugcauagugugaguuaucuaagacaaacugacuauacugugcuauugacugaguaagucaguuuuccacuccaaugcccauuuaaauuguaaccauauuaaaaaaacaaaaacaaaaaucccccgaaaacuccagaaguguaaacaaaauaccauuaauuguuuaaucuuuauugguguaaacaugauuuuuugggagauucuuugacuuuucugguguguugauaucaguuuuagaggacuuuggaaugcugucugcccaccaggacucucucuucucugcugguggucuuguaaugguuuuuuguuuuuguuuuuuguuuuggagguaggagacuucuaucuucuuauaagucacuugauaauuuuugacuguuuguauaaaaauguucuaauugcugcaaaaaggcucuuaaagauauuuuaaauacaaaccucauguggcuuugaggguggguagggaaagggggugauauauuuuuguugaggucauuuuaauuuuuuuuuuuuaccauggcauaaacagaguuucucucauagcuuucuuuguuguauaugauuuucuuuuaaaaagucuuaaauguguguguuuuagaaagaagcaaauuaguuuuccuuggauaauuaaacuaguaucugucucuaugcuuaauaaauuauucauuuuaacccagaucucuuauucauguuuugaaccucucuuuuauuuauuuuggauugaguaaaagaccuucaagacccuggaaaauccugaauuaauauccugagcucacauauuaguuuauuugaagaaagagaagagagaacauuauaaaacucuccuaguuuauacucaaagcguaaauccuucguguaucucucuagaaugugauacauuauuuauacagcucucugauacuaucugcuguggcuuccuucuuuaaauauuaauguaagugaaguagucuuuuaaaauaauguuuaauucaacagaccuguauugggcacauauugugugccagccucucugcugcucagggcagaggacacagcaguggccuuuuaagcgugucuggcuuguccucuccuuugccucgugcugccacugccaggaguucccaucugcccuagcaguuucgugcgucuagucucuccucacuaggacaucuuccaccuuuagccaauucgaagcaucagucuccaucauaacuccuuuggcagacucccauugcucucagaguagaagccaaacucuugagcugaccaaaccguuggcucuuuaucuucauguuccccaacccccaaacuuggagcaucuugcugcacuucagucucuuucacaccguuuuuuuuuuuuuuuuuuaagagacagggucuugcucuaucacccaggcuggagugcaguagcgugaucauggcucacuguaaccucgaaauccugggcucaggcaguccuccugcccucagccuucagaguagcugggaccauaggugugcacccccaugccugguugauuuuuuuuuuuuuuuaaagagaugggguuuugcuguguugcccaggcuagucucaaacuccaggccucaagcaauccuccugccuuggacuccuaauguuuugggauuacagcuaugagccacuguacccagccccuuuuaccuccucucacucuuuuuuuuuaaacugcuaauggaagcuuuaaucaccacauggaaaaacaauacauucauauaucaaaauuggccccaaauuccuuaucaucaucaucaacagucuagaaaugaaaugacacauaauauaaaacuuuccuguuuauaacuaaaagauuuaugaaacuguuuuuuauaaaugccuuuuuuuuuuuuuuuuuuuuuuuuacccugaggaugauaucaccaaagugaaaaaagaaaagucggucauuaucagcuggaauguauucagcauagaguuuuaaaaaccauuugucauuauucuggagugauuuccauucauucuccccacccacacuaugugaugauaacaggaaaagauggcaaaugguugugccagucuuauuauauacuggucauauaauucucaaauauacugaucauaugauugucaauucagucuaccuacuaaaagaagaaaauaaaauuuuaacauccauuaacucugcacuaucauacuuuaaaauaugauuaaaagaaagaucauauuuuaaaauauacuggucauacaauucucagauauacugauuauaugauucucaauucaaucuaccuaccaaaacaagaaaauaaaauuuuaacauccauuaacucugcacuaucauauuuuaaaauauguaucaaaaucaauucucuguuauaaaagagggguuggcuguacauucucagaccccacaacaacaacaaaccaccagaaaaccaggacaauacuuucuuacacaggcuccugccaugcguucuacaaauuucauauaagccaacuagguaaguucagaguucgcauagauugccucacaaauacuuaacucugggcucuuagucaccuucagauaagaucugcaaaugucuaaaagaaaaauaacucccaaauggugcaacaguuauuccagucaagugcugagagagguuugccuauuaaacuugaaaaaagauagccauguugaguaguaggaggagaucucauggaggaaggagacuuguauguggccuuuggcaugagugggaauuaaacauuuucucauucucauuaaggaugaugauuacuuguguacuggguguacucacaugugauggucugcagacauuuaauuacccauuaguugccaaguuucuguucuuuuuaaaauugcauggauacugauaagacuuguuuuugcuaauaccguaugcuuucaguuuuaugaucuuugacagcuguagcaaacuugaacuuggugacaaaaauucacuaaaucggcacccagugucaaccagucuuaaaaugccucuaaagugacaauuaagcuuuuuuauuuaaacaaagguaaacuaaugcuagcauaaaggucucuuaauuuguaguguauaauuuauaguauguaaaguauauaauuucauauaguaaaugauaucuuaaaugauaauuaguggagaggauuugugaaaaguaagaaccaauuuuuggugcuauuucuguuuguuguuagguaauuuagaagcccuaugguaccugauuuugugagugguuauuuuuaugaagagauguaguaauggacuuuacgagaaaauugagaguauacuguccuugaauugaguugaccugucucugaaagagccaagaaauaaaaauaaaaccaaaaaaauugugugugcauuuguguguguguguguguguguguguguguguguguguguggugucuguauuuuaaugauggugaaguauagaugacagcuagucuuuuuuuuuuuuuuuugagacagagucuugcucuguuuccuaggcuggagugcaguggcauaaucucagcucacugcaacuugugccucuggguucaagugauucuucugccucagccucccuaguagcugagauuacaggugcacaccaccacgccuggcuaauuuuuguauauuuuguagagaaagaguuuugcaaggcuggucuugaacuccugaccucagguuaucugccugccucggccucccaaagugcugggauuacaggcaugagccaccaugcccagccaaugacagcuaguuuugauucaucacggcaagguuccccaauuccugggcuguggccuguuaggaacagggcugcacagcaggagguaggcuucaggcgagggggcaaagcuucgucuguguucacagccacuccccaucgcuugcauuagugccugagcuccaccuccugucauguuagcgacagcaucagauucuccugggagugugaacccuauugugaacugugcaugcgagguaucuagguugcgagcuacuuaugagaaucuaaugccuaaugaucugucacugucucccaucacuuccagaugggacugucuacuuacaggaaaacaaacugagggcucccacugauucuacguuaugaugaguuauauaauuauuugauuauguauuacaauguaauacuaauagaaauaaaguguacaguaaucauaauaugcuugaauccucccccuccuccugguccgcagaaaaguugucucccaugaaaccagucccuggugccaaaaagguuggggaccacgggauuagggcauagacuaguucaggggucagcaagcuacaguccacggccaagucuggcccacugccucuuuuuuguaaaucauuuuacugggaugcaguugcgcuuguucauuuccauaucgucuguggcgucuuugauucuacaacagcagacuugaauaaaugcagcacagaccgcacauccuguaaagccuaagauauuuuauauuggccuuuuucagaaauggcuugccagcccuuggacuagauuaacgugugaagacgucuuaaaagaagcagaccuggggaagauauaaagaugaaacaggaacagggaaauuguucaguguguaggggaugcauuauuauaaacuauuguuuaauggguuuucuuucauaaaauugcagguacauagaaauuaccuuuuuuuuuuuuuugcaguuuucuuucauaaaaaugcaagugcauagaaauuaccauuuuucccugcuauuuuagaaccucuuagcuuggauuucugaacaauaucagugaguaagaggauaggucagaugucaccagcuacccugauucucuguauccccaaggauuuguagaucauagaguuuuuucauauuaaacaagcacaggccuguaacaucuuuguuuugacaaaacaaaagaugacuaaaaugacauaguucuuaacuguuguucucuucuuucaaaguaguuacaguauuuaagaauaucuaucaucacuguucuuuccccaccaaaaaacccuuuaaaacauucagguauaauuuauuucuugcucgcugagaucuggguggcuguuuacaauuugugggcacuaauccuccaaggagggauucagggauccaggcuuguuccaucuugugguuccgucaucuuuaacacguuuccacacuuggcuugcuuuguucaucuguguggucacauaagaacaugaaggauuaugugugaguucuaugguccaggcccagaggugguacauaugauguccacucacauucugcugucuggaacacacagcauuaccugcaaaacacauagaaacauaauaucugugugcuagaaagaagaggagaugaguuagauaaccagccagccacaguuacuuguguuucccuuugccuggggcuccaggcuggguaggguacuguuaauccuguugccuuagugccuccagcgaguaucucccucagugcaccgucguccuggcucuggugggcagcucauucccaagagaaaaaaagaggucgggccauucuggguuugugcagcuaauucucacuaaauuuacaaaaauccacuaagucacuucacuucuccuggauggagugagucaaaagccaggaguguuauacaaauuaaacucccuccacguggaaggaauaagccgaagugguauggaaacaacauucucugcauuuccaguuauuuucuagaugcaaaauaugagcugucuugagagcagcauucaaaagcauaaauuaagaguccaaauguagagaaagucuguaucuacuuuaagaaaugguaccggccaggcgugguggcucacgccuguaaucccagcacuuuggaaggccgagguguguagaucacaaggacaggaguucaagaccagccuggccaagauggugaaaccuugccucuacuaaaaacacaaaaaauuagcugggcgugguggugggcaccuguaaucccagcuacucaggaggcugaggcagagaauuguuugaacacgggagggggagguugcagugagccaagauugcgccauuacacuccagccugggggauagagcaagacuucgucucaaaaaaaaaaaagguaccauuggaugugaaagcagucagcccugacagccacuguuguuuuugaucuggucaacuggacagguguuucucaaagcucuuugccgcaucuuugcuaauccaagguggcccauggaccaaaaggauugguaucaccagggagaaggauagaaaugcagaaucucaggccccauccuugccuucugaaucagucaguugaccaaccaaaggcccaguugauuugugggcacauuaaagucagagaaauacuguuucagaauaaaaggauguaauuucaaauuuauacuuguuuucuaaauuauuuaagguauaacuuguauuacuucauagccguccaccauuuugaaaugcauuaaaucaacucuaguuuccugcuguugauuuaagcaacuucauaggaaaucguuaugcuuuuaggaaauugaccaccaaguacuccucuacucgguuccuaggugguagacaugcuccguuaaacguagugcuugagguggcuauuaaguuugaugaaagguaggcugcaagagcaaauuuaagaauguaagcuugcauuaugaaaaauaguaggaaguugaggcuuagaguagaacuguuagcuaccuugaaugguuuuaacaggagguggagucuuaugaauauauuuuuuauaauacaugcugcugaugacauuuuguucagcugcuuaauuuuuguuuuuguuuuguuuuguuuuugagacaaagucuugcucugucaccugggcuggagugugguggugugaucucggcucacugcgaccuccgccuccugaguuccagugauucuccugccucagccuccugaguaggugggauuacaggcaccugccaccauaccuggcaauuuuuguauuuuuaguagagacgggguuucaccauguuggcuaggcuggucucaaacuccuggccucaagugauccgcccaccucggcuucccaaagucuugguauuauaggccugagccacugcaccaggccucaacugcuucguuuuuaguaagauaaaaugauagcuuagauguugugccaaugucaucuuuuuugauucaagggagguugaagaucagguaauauuuuggguuuuaaagcuuacagagcuaaacuacuauugugauuugugaguucuuaaaaacuuuuaagaagacugauaauggcuuuaugauuuggaagcuauaaauuauaacuguauuuguauucacaucuuaaaggacuggcgugccauauauuaacauaaauaaguaguaaaauuacauucugugugguuauaaaguaaugaagccaguucuuauguuuuacuuuuggaaacauucuugauuuuauaguuauaauaugguguuacaagguuaacuauauuagguccaaauuauuaagcuagacacuguggguaauagggagauauagaagacaucuacucuuauauaagccucuauugaguuucuaguucaguuggugaaauaaggcacacagcuauuguauaaucugcuauugacaacugauuuggucacgucaugcaguugauuucucagagguuucucauuuguaaaaugaaguuugaauuggaucuuuaaaauuucuucuagcauuaauaugguaaugaugaugaauucuauuauaugauaauaauuguaauuaauauaaugauucaguucuuuaggugugucucuucacaugaagaaauaauggaauuuuuuaucuuuggggaauaaacaaucacuuuucuuaagcuaagauuuagaaaguuuuuuuuccaaaggcauuggaauuauaccucaaagcuuguacuaguaguucuuugaccauuucuuucagcacauauuuacuaauuuuuaauccuuauaaauccuuagggaaauauauauuuugguaaccguuuaagaggagcugcucuguuacauucccagcucuuuaauaaguggggaauuuguucucucugguccaaaauguucucugaaaaagaucuccuuguuuucccaaaugauucucuuagaaaggaaacuugaucauucugcuuuguucuggaguguuacacaaguguuauaccuuuguucugguguuauaccuuguucugguguuauaccuuuguucugguagguaguacuaccaaaagagaacuugagaaauuaucccuuugggugaggaugguuuguuucaaguuuuuuuuuuuuuuuucccuccagcacacucucugucuuuuuauuuuuuaacuuucugcaucuuguuuaaucaaaauauuucuaagauggcaacuuugaaggcuuuacaaauagcaacuacagcaauaugaagacuuugcuuaugagucaggugagaugaaggcaaagaauauauaugucgagcaaguggugcaagcuuaggacccauucuuaaagucggggagaaauaaaauaggcaguaaaacaaaauggccaacuuuuaacucuuuugacaaacuccugagcgaaggccggucaccccuuuucuguccuuggcuuugucuucauggugguggugguggugacuuaaagccauuguuuucuuuucaugaauggugagguugaucuuccaucuugcuggaacugaucagcuuaacugcagaaccuuuuugauauccaaaucccuguaccacuauuuuuuuacucuugucuacaaaguagaagagaugucaguaaauuuauuuuauauaaaaacaauccuuaaguauuuaugaacacauguuuguggguuuuuuagucucuuugcucaccaauuugaaauuuguuuuauuuuguuuuguuuucuuuuaauagugauagggucccugucacccaggcugaagugugguggcaugaucauagcuuacugcagcugugaacuacugggcccaggugauccuuucucccuagccuucugagcagcugggacuacaggcaugcaccaccgugcuaaaaaaaaaaaaaaaaagaaaagaaaucguagagguaggguccugcuauguugcccaggcuagucuugaacuccugggcucaaaugaugcuccugccucagccucccaaagugcugagauuacaggcaugagcgaccacacccaaucucuuuuugugaauuaaaaaaaaaucauaaacccaaguguacuaaaauguuaagugaaaguuaaaugguugauggcuucuuuauuuuucuguuacucuuguaaaccacuagcuuguaaaucuaaaacauuuaaccuuaacuuuaguggcguuucacaaccguuaaaaauguuuuuauaguauaaugacaugggaaaaugcuucagagacaaugcugaccacaguauaugagucuuaaaagcaaaacucaguauauaauauauauauuuuauauuacguauuuuuauauauaaauauauaaaaagaaagagaacuuuuauauauauauauaaaauauacauauauaguaacaugcacauuauaaagaauccugcccccuuuuuaaauauagcaauuuggcaaaugaucagaugucaaagauugugaagauuucaguuuaguauuauuuauaaaugagaaaagcuggaccccuuuucuacaaaaaguuuuuuaaaaaaauuagcugggcaugcuggcacauaccuguagucacagcuacucgggaggcugaggugggaagaucgcuugagccuaggagguugaggcugcaguaagcuguaaucacaucacugcacugcagcuugggugacaaagugagaccuugucucaaaaaaaagaaaaauaaaaaaagacaacugguaaaaacaaacauaggacuagugauaaaauuauuuauccucuuacauacuuauuuaaaaaauaaccuuggggccgggcaugguggcucaugccuguaaucccagcacuuugggaggccgaggcgggcggaucacgaggucaggagaucaagaccaugcuggcuaacacaguggaacaccaucucuacuaaaaauacagaaaaugagccgggcaugguggcgggcgccuguaaucccagcuacucgggaggcugaggcaggguaaucgcuugaacccgggaggcggacguugcagugagccgagaucgcgccacugcacuccagcccgggcgacagugccagacuccgucucaaaauaaauaaauaaaaaauaacuuugacauaugagcccuuaauucaauuuauaugagguuuaaaaaucaucuuuuaugcacuucagaagaggaaacuugaguaauaaaaaugccauuaauugaagcuaacaauuauuuacaaagacaguucccacgaucuaugcuaagugcguguuugcagugcacuuugcauauauuugcuuaugccacagucuguuaacugaguauuagcuguuagggaagcagaaagcuguagcauauuuagugcuuuuggaaauuauauccccugcauguaagccuaaaaaugaauaaauauauuucuugauuuaaacauuuagcuuggauguauuuuauacuggaggauuaaaaauguuaauuuauguuucauaaaagcuuuuauuaaggcucuugccaauaaacuauucagugauuucacuaaggaguuauaugguaaaaaggguucacaaauuuacacuuuccaucaguauauaaaucacgcagccuucauuuuuggauucaaaaucgcuuuuuggauguguaugugugcacaugcuguugaaaucaacauugcagccuuucuuuauuccauuaaaggcugguaucaggaugcuuggccagaaagacacagagcacuguuagcgaagaaaacugaucguuucaguuuuaacauaguuccuauucugguuuuauucaggccacugaaguuugaaugcagagaaaacgcugcaagauagaaaaaugagaccuacucuucauucggcaaguugaauuaacacacgaaauggcauuuuuucccucccucauggauauuuuuuuuucuuuacaacaguacugugacaucggauugacauugaauacuaggauuagaaaauuaguucaagugugugcguaucuguuugcaguaguaaaaagaguuaacaaauuuacacuuuccaucagaauauaaaucacacagcccucauuuuaggauucacaaugaccuguuugcaguccuagcuugaacauuuggaccuuucuuuggcacugcaguuugaccaaaagcauaauaaaauuuaaguuauuucccaaaaguggccgggcgugguggcucaugccuguaaucccagugcuuugggaggccgaggugggcagauuaccugaggucaggaguucgagaccagccuggccaguguggugaaacccugucucuacuaaaaauacaaaaaucagccacgcaugaagguguacaccuguagucccugcuacucaggaggcugaggcaggaagauugccugaaaccgggagguggagguugcagugagccgagauugcaucacugcacuccagccuggguggcagagcaagacuccaucucaaaaaagcaauaauaauuuauuugcaaaaaguuuuagauuuaaaugcuuucguggguguuuuaaugguuucauuuuuaaguguacaauucaguaguuuucaguauauaacauugugcagccaucaucaguacauaguuuuagaacauacucgcaaaagaaacgucaucccaauuagcagccacuuuagguuuucuuauucuggacauuucauguaaauagugucauauaguauguagacuuucaugacuggcuucuuucauuugauauaauauuucaaguguaauauuauauccguguuguaccaugugucaauauugcauuccuuucuauugcugaggaauauuuugucaaaugcauaagaguacauuuugcuuucugcucuucaguugaugggcauguggguuucuacuuuaugacuauuaugaauagugcuucuauuuagaaucauguacauuugugugcaaguucccauguugacauauguuuucauuuucuucaguagauucuuaggaguagaauugcuggggcaugugguacuuaagucuucuucggccaccauaacaaauuaucauacacuggauggcuuaaacaacaaaaacuuacuuucucacaguuuuggaggcuggaaaguugaagauuaagguucuuuucaggguuugguuuuuggugagagcucuccuacucuucucaguguacccuaauuugguagagagaggggaugaaccaagagugggagagcauucuggugucacuuucccuucuucuaagggcaccagcucuguuggaucagcacuccacgcuuaugacugcuuuuaaccuuaaucaccuccuuaaaggcucugucuccaacauaguuacauaagggguggggguuugggcuugacauaugaauuggagagggguggggaacaguuuaguguauaacauaagguaacucacauuucaagggacuuccaacaggguaccacuggagccuuuaagaaucgacaauuuuuuuuuccccuucaauuuggaaauagcauauguuuaagauaggaauaaaaacaaaggagaaacgugaguucuugauugaucuucagcugauuugcugggcuuucauggccugucuaauaaucacucugcauggaaauaauaggggggcccuucugagaaugaaagggacauguuuacuaaucauccugggacaacagacauacuuugggacugucauaagcaaauuugggugaauugucacucugucagccaacaagaagaaaauacuauugccagauuuaccuccuccucucuuugacaagucccugggagugggggagaggcauaucaguuauaaagucagggacaggguuaacgagcaaugaccccaucuuccauuuugccccauuugcuauucccucaaauuaaaaaaguaucuugaaaagcggugauagauugccugauuauaucucaguuacccacaucaguaguuguggggucuaaaugugaacauaaagugauugaaacuaaucacuuagugauugaaaccaagggguggccuguuaauuuuucuuauaguuacuugaguuaaacauuuuauuucuuccagggaacaacaaaucauuuaaucuucagagcaucuuagacugaaaaccuuucaacugugcugaaaaaccuagaagacagaccauuuugcccacccucucauuuaaaaggaauugaagaagaaauaaaauggcagagguuuaagguuacuauucaggaugacugaugauaauucagaugauaaaauagaagaugaauugcaaaccuucuuuaccagugauaaagauggaaauacacaugcauacaacccgaaaucaccaccuacacaaaacucuucagccagcagugugaacuggaauucugccaacccagaugacauggugguugauuaugaaacugacccugcuguaguuacuggugaaaauauuucuuuaagccuucaggguguugaaguauuuggucaugaaaagucuucuagugauuucauuaguaagcagguguuagauaugcauaaagauucuauuugucaguguccugcacuuguagguacugagaagcccaaauaucugcaacacaguugucauucccuagaagcaguugagggccagaguguugagccaucuuugccuuuuguguggaagccuaaugacaauuugaacugugcaggcuacugugaugccuuggagcuaaaccaaacauuugacaugacaguggauaaaguuaacugcaccuuuauaucacaucaugccaucggaaagagucaguccuuccauacugcuggaagccugccaccaacugguaggagaaguggaaguacaucuucuuuauccuauuccacuuggacaucuucccauucugauaagacgcaugcaagagaaacuacuuaugauagagaaagcuuugaaaacccucaagucacaccaucagaagcccaagacaugacuuacacagcauuuucugauguggugaugcaaagugagguuuuuguuucagauauuggaaaucagugugcauguucuucaggaaaggucaccagugaguacacagauggaucacaacaaagacuaguuggagaaaaggagacacaagcacuaacaccaguuucugauggcauggaaguccccaaugauucugcauuacaagaguucuuuuguuuaucccaugaugaauccaauagcgaaccacauucacagagcucauacaggcacaaggaaaugggccaaaaucugagagagacaguguccuauugucuuauugaugaugaaugcccuuuaauggugccagcuuuugauaagagcgaagcucaagugcugaacccagagcauaaagucacugagacugaagacacacaaauggucuccaaaggaaaggauuugggaacccaaaaucauaccucagaauugauucuaaguagcccgccaggacaaaaggugggcucgucauuuggacugacuugggaugcaaaugauauggucauuagcacagacaaaacgaugugcaugucaacaccaguccuagaacccacaaaaguaaccuuuucuguuucaccgauugaagcgacggagaaauguaagaaaguggagaaggguaaucgagggcuuaaaaacauaccagacucgaaggaggcaccugugaaccuguguaaacccaguuuaggaaaaucaacaaucaaaacgaauaccccaauaggcugcaaaguuagaaaaacugaaauuauaaguuacccaagaccaaacuucaagaaugucaaagcaaaaguuaugucuagagcaguguugcagcccaaagaugcugcuuuaucaaaggucacgcccagaccucagcagaccagugccucaucacccucaucagugaauucaagacaacaaacagucuugagcagaacaccgagaucugacuugaaugcagacaaaaaagcagaaauucuaauuaacaagacacauaagcagcaguuuaauaaacucauuacuagccaggcugugcauguuacaacucauucuaaaaaugcuucacacaggguuccaagaacaacaucugccgugaaaucgaaucaggaagauguugacaaagccaguucuucuaacucagcaugcgagaccggguccguuucugcguuguuucagaagaucaaaggcauacucccuguuaaaauggaaagugcagaauguuuggaaaugaccuauguucccaacauugauaggauuagcccugaaaagaagggugaaaaagaaaaugggacaucuauggaaaaacaagagcugaaacaagagauuaugaaugagacuuuugaauaugguucucuguuuuugguaaguaauauauauauauuuuuugcaugcuucagagaacuguggagaaaacugagauguguuagcauuuaguuaucuauuagucaauaauauugcagaaccaggugggcagauuuacauuuaguuguuaauucauugucuugucaguacugggguguuaauagguuucaauacaacaaaacugcauauggaaaaaaaaauccucaauuucaguauuuuguaucaaguaucaccguuccuuuuaauagugugcugaaaaaugaaguuacuuuaauauuuuaguauaauuaguaguuuaagugccugauacaaucagguuauauuuuauuuuucugaaaaaguuggguugucaacuuuaaaauguauuggacagcauuuaagaaagggcuugggagugcugguaaacaugucaacauaaaaauaacuccuggacucuugcggaggaggcagcucugggaaguagagcccucuuguaugagcaagaguguucuugauuuuuccucugaccggccaauaaugauuuuuggcaaguaauuuuucgagacccaaagaugaaaggauuggaccuaguggaugugugaagccucuugcagccuuaauauauuaauuccugguauauaaaauaaaaucuuuuacuuauguauagugaaaaaccaguauguuuuccauagcgccugucuaaaauauuugggggggaccuagagagugcuguuuaaagaauaaagaauucacaugcaguguaaaggugauuuuccuuuaaacaugcauguguuuuugagaauaguguguagaaauugguuuucuggguuuuaaaaacauuugacaggccacuguuggucguugggcauguguccucagcccuauuuuuggcaguggggacuuagguguauuuucagccccagacaggcuguccuugggugccuguccucugggccaggaagggagcuaagugccagcggagaaaggcaggugugacacagacagccugucccuuggagggcucguggcaagaggaaugaagcacauagaauagcaagugcagaagggcugacuuaggugugucuucagggugcauggggaccacaagggagggaauugucagguccguuuagaagacaagguuaggaaagaccgaagauauucuagauucucuaaaacaucaguuuagacauguuugggcuuuaacaaccagucuucucuauuuggaagaaggguacaccacagugauuucuaaacuaaugaguucauccguuguuucaaaacucagauuuaguuuuuaaguuaucuugaagucaaacuuagaaaaccgauaucauuuauaauuuuaauuuuuuugcaaaauuaaauuacaacauacucuuaauucuaaucaacauucuuaguuuggcauuuacagauauacauagaaacacgauguuuauucucuugauuuaugggagacuuuuuuuggugugucaguccccagcuaccaaaaacucuaucauaaaguuucuuuuucuuuaaugacauuugucuugaauuuaaauugguuguguaauuuugaaacuaaaaguuuuccugauuugugcauugagucuuaggguuauguugccccugugcagcuugaaaaccuguuuuucaggcucccgaugugguacugagguaaggauagaaucaucagguugaaauggauccuaguaugucuuggagaaacagcacuuuucgccucaggaaucuggcuguuaggauucauaauuagauaugaaauacuuuguaagucuugaaagauugucccauauucgcauaugcuuaucaacuggcauaagggacucuuuuuucuuuuuugcuuucuuuuuuuuuuuuuuuuuuuuuuuuaaggcagagucuuguucuugcucuuucgccaggcuggagugcaguggcaagaucucggcucacugcaaccuccgccucccagguucaagcaauucuccugccucagccucccagguagcugggacuacaggcgugcaccaccacauccagcuaauuuuuguauuuuuaguagagacgagguuucaccauauuguccaggauggucuugaucucuugaccucaugauccaccugccucggccucccaaagugcugggaauacaggcgugagccacugcccccggccuacucuuuuuucacgaucaugucugaagcacagugcucucuaauuuugcuaguuuaccucuugcacauuuccaugucucugggaaggaggacuggaaagugucugggcagacccucauaggccacuggcuuugcacuuacuguagagagcugaaugaauuugcugcguguuuuccugaaacaugaaugucgguuggucacuucagcagcacucaaaggcucuuacugcccuggauugacgaagagaccaugcuggagggauguuaauuuucuuuuucuuugagauggagucuccucucucacccaggauggagugcaguggcgcgaucucggcucacugcaaccucugccucccagguucacgcauuucucccaaguagcugggacuacaggugcacaugccuggcuaauuuuuuguauuuuuauuagagaugggguuucaccacguuggccaggcuggucucgaacuccugaccucaagugauccgcccacauuggccucccaaagugcugggauuacaggcgugagccaucgcgcccggucggauguuaauuuuuacuguugcuuuguuggccuuggccugccuuaggccuugaguuuacugaaucccuagacugccugcaaccucacagcucauugguggucaggguguaucugaaucuuuagaaaaguucuuauuuggaagaaggaacuugauuuuuauuugaaacggggcuagauguagcuccucacaacagagguuauguguucaugauagugugugagauaaagggaguggagacuuaaccuaaaaggaaaggaauugauauuuauucagugcuugcucugggucaggcacuuugcucaggugccuuaguuauauuaugccauuuaaugggcccuguaacgcucaggugcuuuccauacauuguuauuuacucuucccaauaacaacagggcaauuguugucgacauuuuaauacuucagcgaggucacuuaaaacucacacagcugguaaauaguaaaauugggauucacacucagagcccucacuugaauccuggccuuuucugcuccauacaccauacgguuucaaaauuuuuggaauguuggcucugaaaggcaaaacaagugauuugcugaagauucacuuuuguaaauugaugagcaguuugccuuacuuuuuaaaagaagguuuucucugggagguuaacuuuuggguugcuuuuuaaaagaagauuuuucucugggagaugaauuuagccagcuuuaauuuaaccuagccagagacagaagaucuuuguuaguuuguguacagucacuugcuuuucuuggccaauucuguauuguucuccagugccaaaacaugaccuccagcuguucucaugggugauuggccugcuaaguuauuguugaauucaccuaauguaugaauucgacugccaucggcauugggcuuuauguguaucuaucggaaauuaacacuugagauuuauuaaagaaagaagagugaugacagggaacaugcugcuuuacaagcacggauuuuagaguaguuucaaauuguagcuccaccauuuacugggcaaagugaccucuggcagguuacuaagucucuauugagcucaguuguucuuugugucaaaaaaagggucaaacucuguaauauauuugaagagauuuauucugagccaaacaugagugaccaguggcccaugacacagcccuuaggagauccugagaagaugggccuaaggugaucgagguacagcuugcuuuuacacauuuuagggagacauaagacgucaaucaguacauguaagguauacagugguucugucuagaaaggagagacaacuggaaguggaggcagcuuccaggucacaggcagauuuaaagauuuucuuucuuuuucuuucuuuuuuuuuuuuuuuuuuugagacagauucucuguugcccaggcugggggugcaguggugugaucucucggcucacugcagccucugccucccggguucaagugauucucuugccucagccuuuugaguagcugggauuacaggugaggaccaccacacccagcuaauuuuuuuguauuuuuaguagagacuggcuuuccucauguuggccaggccggucucgaacuccuggccucaugugaucugcccaccucggcuucucaaagugcugggauuacagguuugagccaccacccccagccuaaagauuuucuaauuggcaguugguucaaagaguuaaagaccuggaaucaacaaaaaggaaugucuggguuaagauaaggagcuguggaaaccaagguuuuaucauacagaugaaaccuucagguagccggcuucagggggaguugauuguaaauguugcuuaucagacuuaaaagagucuguucuaucagucuuaaggucuuuguugauguuaaugcuggucagcugugccugaauuccaacccuucggagaguauaauuaugucugacucccccuuccuuucauauccugaacuaguuuuucagguuaaccuuggaaugcccuuggccgagagaaguggucccuucagaugguuggggggcuuagaauuuuauuuuugcuuuacauuaauguaaagggagaauugcaaauuguaguuugguguuggaauucacacugugaguaaggcucagacucccauuuccucuauguagaauagaaacauuuauugggugcauacuauguauuauacauauggugaugauuguuaggauguagggaaaaaagagacccugucugagugccuagugcaguggguaauacuguugcaggaguuuuucucaacccauuuguaaaacuugcgaugggggugccccauucagcccgccaugcucaaccucuugcgggcaggagugugugggcaagugaguacaggauccagccagccacuuugagcaccggcaggagcaugcugugugcaggccccacaguggugcccaggugguggugucugugacccuaaagccccagagggcaugcuacagugcucucuuggcuccaccauccauggacaccggugugucaucagcucagugggcccuuugccucacuguguggggcagcugcccuccaguagcgagggcaaagggucagugugauaaccuuuuuuggguacccaaaguuggugggucccaagcucuuguccacuguccaagaagaauugggucacauggacaccugaaggaugguggaggcagauaauuuuauuuagcaaugaaaguggcucucagcagagaggguagcugaagacgggacaggacgggcagauaaucuucccuaaagucuggccaucuacacuuggcucuucuccaaagcuaagccaucucuccuccaaaguccagcugucugucugccauccaaguacuaaccaggccugacccugcuuagcuucaaagaucaggcgagauuggguguguucagggugauaugacaguagacucagcuguccucugaagucuccaguugauaugauuuggcuguguccccacccaaaucuuguauugaguucccacauguugugggaaggacccagugggagggaauugaauaaugggggggcaggucuuugccaugcuguucucauaauagugauuaagucucacaagaucugaugguuauuauaagggagaguuuucuugcaugagcucucuuugccugcugccauccauguaagacaugucuugcuccuccuugcccucugccaugauugugaggcuuccccagccacguggaacucuuaaguccaauuaaaccucuuucuuuuguaaguugcccagucucauguacgucuuuauaagcagcguaaaaauggacuaauacaucagucaagccgcuugucuccccuaccaagugagucuggggucuuuacaugaaugggauguggggggcaaggcaggccauagguaguuuuggaaaaggcaacuuucaauugguaaaaagacauuauucagaaagaacuaauuaggagagagugggcaaacagguuuagaaguucucacuuuaggcuguggguuucaggguuuuugccuugaaggugggguuuugcuggggaccugcccccgucugccuagaauuucucugccuccugccucuaucaauacaguaaacaggcaaggguauguugauugcuaaguugggagugugaguagacugcugugcugcaggagggggaacaagaugugguggugggcagaguugucaaggaaggcuuauaggggacaucacauguugucacuagcuggaauuugaagggcagguauucuggguagaguacaaagcugaagaaauaugagaagauuuucuaauuuaggggacucuagguagguguggugggagcugggagaauggaacccugagcaguagggaauaaggugaagaggauggcaggggcuuccauaugcaaaaggauugcugggccuugugaagaagauguuaucuggaagacagacagaaggugucuaacccuauucgaguuugagagagauugcccuagcaggcagauaaaagaugaauugaaagcuggagagaccagaaagauccuguggacaucguuucaguaaucuugcugagaaaugacagcagauggaaaagagaaacagcuuucauuguugaaguugggugccuggguauguuguggugaauacaggaagagauaaguuuugagauagauaggaaaguaagauuaauuuuagaaaaugcuucauguucuuguucuuuaaaaugggguacaauaaaccuaccaacuucacaggauuauuaugaggguuaagugaauugauacauauacuuagaauuuagaauaguauucuauacgggcuauauguuaguaaguuaaguagagucauaugguuuggcuguguccccacccaaaucucaucuugaauuguagcuccuguaauucccacauauugugggagggaccuggugggagauaauugcaucaugggggugguuucccccauacuguucuugugguagugaguaagucucaugagaucugaugguuuuauaaggggaaacugcuuucccuuggcuuuuauucucucuugucugcugccuuguaagaugaaccuuucaccuucugccaugauugugaagccucccuagccacguggaacucugagcccauuaaacugcuuuuucuuuauaaauuacccagucucaggugugacuuuaucagcguugugaaaauggacuaauacguagaggugcuugaaggaugcugaguugggauguauagaaagaaguuagguauaugggaaacucaggagagaguacugguugaacauguggauuuggauguaccaguguacacguggcaauugaaacagcagccaagaucauguaggaagaguacauggugaggaaagagaacagggccaaggcuaggucuucaugaagacuagcuguaucagucuguucucacauugcuauauaaagaacuaccugagacuggguaauuuauaaagaaaagagguuuaauugacucacaguuccacaggcuguacaggaagcaaggcugcaaugucuuguaugacuggaggaggaggaagagagugagggggcaggugacacacccuuuuaaacaaccagaucuuguaagaacucacugucauaagaacagcaagggggaagucugcuucuaugauccaguuaccucccaccaggucccuccuccagcacuggggauuacaauucgaugugagauuuggguggggacacagauccaaauuauaucacuagcuuccaaagguacagaagaauaggacccagaaaaggaauaaccggacagguagaaggaaaaccaggaaagagcuuugucaggaaaccagagaauggaguuauuaacguucgauguguagagagagcccccaggggaaggauugaaaacuagcuugaauuuaacuugugacacuggugaucuugaguacacucucacuaauggguacaaaggcagaauauggugaauuaaagaguaagcugugaagaguuuuaauuguuucauaguaaaaaugaaaauugaauacagucagcccucuguaucuaugggcuccacaucuguggauugagccaaacuuggacugaaaauauucagaaaaaaaaucugcaguguuucaaaaagcaaaacuugaacuuacuacaugcugaauacuauguugaauccaccugaaacaaguaauagguagauguuguaaguaaugaucguggagaugauuuacaguauaugggaggauguacauagguuauaugcaaacccuacaccauuucauauaagagauuugaguguccauggauuuugauaucugccaggguccuggaacuaaucauuuuugauaccgagggacaacuguacacguucacuuagaaauuguuccuuucacguagcuaauaccacaaggaagugguauggggaagguaugaucuggauuaaaauuuuguuaaugaaaaaagccaaacucuaaaucauuugaagagacuuauucugacccaaauaugaggaccauggcugaugacacauccucaagagguccucagaacaugugccuagguguuuggguuacagcuugauuucauccauuuuagggagacagaggacaucagucaauacauuugagauacacguuaguuuggucugggaagaugagacaucuugaaguagggacuuacagaucauagguggauucaaagauuuacugcuuggcaguucguugaaagaauuaaguuauuggcucacgccuguaaucccagcccuuugggaggccgaggcggcagaucacgaaguguggaguuugagaccagccugaccaacauggcgaaaccucaucucuacuaaaaauacaaaaaaucaaaaaaaaaaaaaaaaaaaagaaaacauggugaaaccccaucuccacuaaaaauaaaaugccaaaaaaaaaauacaaaacuuagcuacaaaaauauaaaaauuagccaucucuacuaaaaguaaaaagauugaugguggugugcacccguaaucccagcuacucaggaggcugaggcaggagaaucacuugaacccgggaggcagagguugcacugagcugggaucaugccacuacacuccagccugggcgauagaggagacuccgugucaaaaaacuaaagaaguuauuaucuaaagaccugaaaucaauagaaaggagugucucgguuaagauaagauaaggggcuguggagaccaagguucuuauuauguagaugaaaucucauacguggccgccuuuagagguaauagauggcaaauauuaccuauuuagacuuuuaaaaggugcuagacucucagcuaauuucuuugggaccaaagaucugggaagggaagaagauucucuacagaauguaaauuugccccuacaagagacagcuuugcagggccauuucaaaauguguuaaagaaaaauauuuugggguaaaauacuucaauuuccuucagggcuugcugucugucaugugaugcuaaacuagagucagguuggaauuuagugucuuuuugcuauaaagagucuguuuugucugacuuaagguuucuguuuuaauguuaauucuggucaguugugccugaauucuaaagggaggagaguauaaugaggcaugucugaccucuuugccaucauggccugaacuuguuuuuuagguuucuuuggaauugccuuggccuagaggaggggcccauucagucaguuggggggcuuagaauuuuaguuuugguuuacagucuuaacuguuauuuucacagggcucugcuucaaaaacaacgaccaccucagguaggaauauauccaagccugacuccugcgguuugaggcaaauagcugcuccaaaagccaaaguggggcccccuguuuccuguuugaggcggaacagugacaauagaaaucccagugcugaucgagccguaucuccucagaggaucaggcguguguccaguucugguaagaauaaaauaguucaauaguuuaugaguuaauugaauguaaaauuggacagucaugauuauaggucuaaugccuucugucacuaaagcaguuagccuuuuguggaucagcauccugagcacaggagguagaaaaagaagaugacaacauauaucccuuaucuuugagcaaggcaaaggcuaguugaggagagagguauagguguauaaaccaucuuauaagcuauucagaaggauguguacauaaauauacaauuggguggcugauguaaauuugaaucauuucauuaaguuuuuucaaaugguuaagugcuuaacaaugcugaaguguuguacgguaggucccuagugugcccucaauacaugugaagagauuaauuuuuuuuuuaauuuuacugaaagauguaugauagauuuaggagggauaugagggugacuaaaaaguuaaauuuuucuaaugugaacuuuuauuuauguuggcuuguaucuuacaauuuguaauuuuaaagucauguuaggccaaugaaaugugagcgccucaagaauagcuauuaaguaucauacuaaauuuggcggacguacagaucuguguuacaaagaaauggaaaagucaucccugugucacggggaugaaaagccugcuagccauuccaauugacugagaacaucuugcaaagaacccaccuuacuucugccgguacagccuugggcaaauuaaagucaugucaaaucaauuuaguaguaaguucccuuauacaaauaguuauguguccacacacgugagaauguuuuauggaaacuaaugaaagcgagcaaaucccagaagaucucuguaccucucuacaauuuaguauuuguagguuucauuuuucaacccuaccaugaagccucaagugugaaagccuguaaugcuuagaaauguuuuacgggcuguuuauuuagauucaggccuagugucaaggucaaggagacaugaccacagaggcgugaguggaggaagagggguuugcagcacauggcuccauccccagaggaucuggguggaaacaggaauucauuagcuuggaguguucaucaucugggagaaaaacagaggccaaaagccauugggagaaagagugauucuuauuugggauauugccacaccuggggagucaaggcaugagugagaugaaagcucuaguccuggcuggguguggugguuuaugccugaaaucccagugcuuuaggaagccaaagugggccaggaguucaggaccagccugggcaacauagcaagacacuaucucuaaaaaaaaaaaaaaaaaaaacaacaacaacaaaaaaaaaaaacagcugggcaugagagcaugauggugugcccuuguaggggcuccucagcuauucaggaggcugaggcaggaagaucacuugagcccagaaguucaaagcugcagugagcuaugaucaugccacuguacuccaaccugggcagcagagcaaaacccugucccuugguggugaagaaaaagcucugguccuuacuguaguuguccaauaaggcucauggugcuugcagagaaugggaagcucccuuccuccucugugaggaacaccuguagcuugguggcacuggaguguggccccuggccugcaguuaggagcccuguguuuuaguuccacucuggccccaauacgcugccugagcaagucuuuuacucucccugggcuucaucuucacaucuugaaaguguaagugucugagaaucuaagacccugucagcuuuuacagcccuuaccuuucuagggacaauuuggagcucaccuaauuuucugaguaacugcuguuacugguaugauucucugaauuucguggggcuugaaucccagaaaaucuaagcgcacauacuuuuaagaaaugaggccaguacccaggauacauugaaaaagauagaauccuuuuauguaggcgaucagucccacccagcggggaaguaguuguuaaguccuuuuacucuguguugcauaaugugucuuagagaaaaguggaucuguuuagucuuagugaaaagacagggcaugcuuuugagcuuuuaucauccugugucgaugagcuugauaacugaguuaugcauccagauuuuucagucugaguuaaaaacuaauuacguuuuacugggugguuuucuguaucugaauggaaacaaaguuaauguaacuggaaacauucuggauuugaauuugaguuuuguauuugacugguuagaagacuuuuauggucugaauacuugggucccucuacauuaauauguugaagccccaaccugcaaugugauuguguuuggagacagggcuggugaggaggugaugaagguuaaacggggucauaagagugggauccuaauccaguagggguggugcccuuagaaaaagaugaagagaugggcuuggcaugguggcucacgcuuguaaucccagcacuuugggaggcugaggcagguggaucaccugaggucaggaguuugagaccagccuggccaaugugggaauguggggaaaccccuucucuacuaaaaauacaaaaaaaaaauuagccaagggugguggcaggugacuguaaucccagcuauuggggagggugaggcaggagaauuccuugaucccaggaggcggagguugcagugagccgagauagcaccauugcaccccagccuggguagcaagagcgaaacucucuuucaaaaaagaaaagaggaagagacacuggaacuguccucaguaugugagguagaaugagaauguggccaucuggaugccaggaagagggcccuugcugggaagcagaucagcuggcaccucuaucuuggacauuccagccuucagaacugugagaaaacaaauuucuguuguuuaagccaccccaucugguauuauuacuauuauggcagccugagccgacuaagaagacuaauuugauucuacuguauuauguuuuacagaaaaauuaauagcaacuaauuuuuuuggaugcucucaguaaauugagagguguuucuuaaucgccacagaguuaaaaguagaacagaaaaaucaaggagcagaaacaaugugcuuuuagauccccgugauccuguugccauugauuguacaaugaagugucuguguguauuagcaaauugaaaccaaauggauauccaccauacugacucacaguuacucugcugaaagguaagcggcagaaauguuccagccaauuuggcguuuucaauaaauccuuucagaacacuuaaguagaaaaccagacccaguauugaaacagccauuuucuugaagcuuuaaaaugaaugugagaaggaauuguaauuaaacccaacacagcuguucuuuuuccuuuuucuuuuccuuuuuuuuuuuugagacggagucucgcucuguugaucaggcuggagugcaauggugcaaucucggaucacugcaaccuccgccuccuggguucaagcgauucugcugccucagccuccugaguagcugggauuuacaggcacccaccaccacgcccaacuaauuuuuuguauuuuuaguagagacaggguuucaccauguuggccaggccggucucgaacuucugaccucaggugauccacccaccuuggccucccaaagagcuguuccauuuuacuugucaaaauguggaaauauauuauaugagaccagauuauaagagauuauaacaaaccaaaucuaaacuaccuuugcuucuuuggaaauauacugaaauaagaugagauagugaugaaaauuauuuguaguaguaauuauuauaaugucaaugauagcagcucacacuguuaaguauaugucggguuccaggcucaguuuuaguaauuucaucuauaaauucauuuaauccucacaguaacuuugaggcuuaucccuauuuuauagacaaggaaucuuccacagaaaaguuaaauaauuuguccaauguuaaacagcuggaaaguggcagaggugggauucagaccagccagugaugcuguuaaccaacacauuauuaaucucaauacuauuaguauggccaugaguuuuguuuguuugauuuauuaauuuauuuauuuauuuauuuaugagauggaguuucacucuuguugcccaggcuggagugcaauugacgcaaucguggcucaccacaaccuccccuucccugguucaagcaauucuccugccucagccucccgaguagcugggauuacaggcaugaaccaccacaccuggcuaauuuugcauuuuuaauagagauaggguuucuccauguuggucaggcuggucuccaacucccgaccucaggugauccacccgccucggccucccaaagugcugggauuacaggagugagccaccgcgccuggccugaguuuuauuuuuaauaauaaagucuaauuuguuuuuuuguuuguuuguuuucuguuuguuuguuuuuuugagacauuuucacucugucguccaggccggagugcacugacuccaccauagaucacugcagccuugaauuccuggacucaagaaauccuccugucucagcgucccauguaccugguaucacagaugugugucagcaugcccagcugauuuuuauauauuuuuguagagaugggggggucucacuuuguugcccaggcuggucuugaacuccugggcuuaagugauccucccaccuaggccucccacaguaccgagaugacaggcaugaaccaccacaccaggcuaacguuuaauuuuuuuaaaaauuaaaauucuuguugcccagcugaaugguuuagaaacuguggcacuuuucuuuucaggccuugguuuaaagcuugauguuaacucugaugugaaugauuuuauguggcuauugaaaauuaaugcugcuucaggaaaaauagcuaaugcaugccgggcuuaauaccuaggugaugguuugguaggugaagucaaccaccauggcccauguuuaccuauguaacaaaccugcacagccugcacauguaccccggaacuuaaaacaauaaaaaauacaguaauaauaaaauuaaugcugcugaauaaauaacugcugaguaaauccuucaugaucaauucagacaucuuuagagagacccgccuucacucucuuuuggaggcaauaccagcuuuucccagguuuuagaugauaaauaucuguguucuucucuacacacaugaguugccauuucagaggccagccugagccagguaggauuacagaaguagcgcagaaugcucucccugccccgugacuccugugagcugaggagggagagugcguguuuaugcagcaaacacaaagcggcacaaagaauggugauggguggggaaaaggccccaugagaagaauguccaggggugggucggugaagaaaggccuccugaaagagaugguuuuugguuuucuucuagagaaagagaaaccacauuucaaaagggcaacucuuuauuucaguugaguuuauuguggguuaauaaaguaaauuccuuucaagacaguaguccguccgaaacuugcagugacuugccugucaucgcagguuucucuucuuucuugcuaaguuauuuccuucgugguuuauguaaacugauuauuuuuucauucauuucguguuaagguaauuucaaaucuucuucaaauuacuuuuauauccuuuuaaacuuuucuaggugagaauuugagggagacaguaagcaaaauuaugagagauuuuucacauacuugaauaaaguaauuacuaaaaaucagagguuauuacccaauaaguuauucuaaaagccaaguugaggccggacaugguggcucacaucugugaucccaggaauuagggaggaugaagugggaggauuacuugagcccaagagauugagacccaccugggcaacagagugagacccugucuuuacaaaacauuaaaaaauuagcugggcaaguggcacacacuugugguccuugcuacucaggaggcugaggugggaggaucacugaacccaagugguugaggguucagugagcuauaauuguaccacugcacuucaggcuaggugacagggcaagacccugucucugaaaugugaauaaaauuuaauuuuaaugugucgcuaauagauguuucuauauuuuuauguaauuaaauuaguuuccuuaaaguguguaucaggaucucuuuucauaaaaauaguauuagucacuaacauguuuugagugccugugugcgccaagcacagugcuaagcccucuuuuaaaugcauaaucucauuuaauucccacaacuccuaguagggauacugugauaaucgccauucuacagaugaggaauuugagggucugaaagcuucaguaacguguccaaaguuacacagugggguaauugguggagacgggaaaugggccggguguucuggccccacagucugugcucuuaacccugguccuuuacgugcaugcagaagucuugacacacuccugucuucuuucauggacauaugugaauucuucauuaaaccacauaugugugaaggagaauguggggaaggcugguuugugcuaagaacucuucuaagugcuggaaugaagugcacagaagagacccguuccuuccauuagggagcuuaaauucuaauaaggggauuaagaaaauaaauacauuuuuggauucaugaugaugaauccaaaaauaaaagagaaagagccaaacaugguggcucacgccuauaaucccagcacuuuggguggccaaggcagauggaucacuugaggucagaaguucgagaccagccuggccaagauggugaaaccccaucucuacuaaacauacaaaaauuagcuggguuugguggccggugccuguggucucagcuacuugggaggcugaggcaggagaaucucuugaaccugggagguggagguugcagcuagcugaggucgcaccacugcacuccagccugggugagagagcaagaccccaucucaaaaaaaacaagcaaaaaauaaaauaaaauaaaaauaaagcagugaaggagauuagauuuuuaaacgguuggucaagaaaggccucacugagagggcgacauuugggcaaacaccugaaaggaagggaggagggaggcauuugggugucaggcgggaggacuuuccaggcacagggaccagccgugcagagaccccgaggugaggcaggguguagggugcgugaggaacagugaaccacgcacuguguguggugggggcuggaggacauggaugggcggaggaggucaggaccaaccaagcagggccaugcaggugccugcgaggcacauguccucuuuucauccucacggacaucaucacuuguaaaugcuugaucuuuuccaggcguuucacacaauucuuacuuggcaguaauuauggagaagauugcuuuguggaaugacucaugaguaggcuuaauaugucacagugcaggcuugcccauucauucaagaagugcuuagagucgcugcucuguguugggcaguguacuagauucugagacuacaaacaggauuaagcaaauaugcccucuuaaggagcuuacugguuggagggugaggggauaagggggugucuaagcaaaucguuccaaugaaaacucuuggcucuucagauuccaccucagcuguccuggccucucugcugcuuugcauuuauagugcuguaugcucauuauuuccuuacaugucugucuccuucuagacggugaaauccauaaggauagaguucagcucuuaguuauuuucauauuuuccagugcccagcacaguguacugguugcacaacagguguuuaaaaacauuccuuggcuugauuugaauggagaccugugcgaagcacuguguauccacaguaaaggagcaacacuaacuuguugugagggagaacuggaggagaggcggugacauuugaacuguuuggaaugcgccugcaggagcuugccagcagaggaggcugcugggguugcugagggugcagauguggccuugucaaaggauaccaugugcuuggggaacgucaaggccagagucagcaugccuggagcagacgugucccggggucaaugacagaugagccucugccucgagggagguagaggcugauuaguucuaauaauguagacacaaacuugcacgagugcuacauauuuuuugggaacggauaguagaaugcauguuuaaaauaauuaggagacagagugucuggccacuucuguuggugugaacaguccuaagugucuccccaaccgccgccuucagaggcuggauagguggugggccaugaagugaaauguggaauagaguagcaagaaguuuuccggaggagaauagugaguuuaauucggggcaugugaaauuggaggaggcuacagacugggaagcaccucagagggguaugugcaugccugagguuuaagaguaaaaauauguagagacuaaggaaaccaucagaaaagagcugacauaaagauauaagagacaggcccaguggcucccgccuguggucucagcuacuagcuacucgggagccugagacaggaggaucucuugagcccaaauuugagucuacagugagcuaugauugcaccacugugcuccugccagggugacagagcgagacccucugaaaagaaaagaaaaaaaaaaaaguuggugugaaguuuugaggucucaaugaucucaccaccucauugcucaguggagcucugcucauaaaccuugacuccuaaugagccaggaggcucacugugcaccuucuuuuguucuuaucaggcauuauuagcauaggugucagaugguaaauaaauuugcuggugaacaugugaagacccuuguuuaucuccuuuguaugguagcugggaaaaugaagcaacaccuuuaagucuuugguuuauuccccucugaauuuaaauguuccuguaguugugggacacauguuccaggccugugacuaaggcaguuauuuuuguuuaauccccaccugaagccacagacaucuugugaacauacuugcagaggcagguacugacagcaucaccgagaaugcugcgcuucuguggaguucgagucaucgugagaacuucccuuugugggacuuuuugcuccuuugucaaauuacugcagucuuaagacuugccguguuuuuguuaugacucaccuguguugcucugccuuugucuggggagcuuacccuugaauuuaagcaaaugaggauaguuauacagaguccuauugccuugaugaacucaagaagguggaauaguaaaaucacuauuugcaacauauaaaucuagaguguuacugaaauauucuguguucugcaacguauuuacuuaacagauagagcguguaugcuagguaagucauguaccagacacugagggauugugggaugaguaagauguaguuuuugccuucuugguauuaacugccaaauagaagaggugacaaguucuuguuucaucacauuuguucuuauaauacuaaaauuuaauaaaaagaacuguaggauuuuggaagaggguguaauuacaaauaccaaaguucgcuuaaugguuuucuuucuguaauauaggagauuauauaauguaauagaguuacacucuuaaauagguaggggccaggcuugguuuaauguugaugcuuugugcuguuuaacuuuugcccccugagaucugagaaguaaggaggaugcacauguauugagcuauuuuucaggacuugacugagauacuagaagguagaaugagaagaggaguuauggcucagaauauagaauguagagauugaggucaaagucaguaaugauggugugaaaauacagaggagggccaacaggugauuaggacacaacagauuggcuuucuggcagucaacaaagaagaggcugaccuagagccucuugucaaugucaagaaagggaugcggggcccuguuuuauucuuuaccucuugugucuugaauuuaaccaggcaaauuggauaguuuaucaaguuuacacuacucucuucccaguaggcuauuuuaaagguauagcauuuuaaauuaaaagugagaaaauaaacaccugucaucuuaccaccaccaaauagcuuuuaacuuaaaaauuuaugacuauuugguaccuuuucuuuuugcauauucucaugcacauauguuuauguauauaauggagacagugucugcuguuuuuuuuuuuuuaauuuuuuugaggcacagucuugcugugucgcccaggcuggagugcaauggcaugaucuuggcucacugcaaccuccaccucccugguuuaagcgauucuccugccucagccuaccgaguagcugagauuguaggugccugccaccacgcccagcuaguuuuuguauucuuaguagagacaggguuucaccauguuguucaggcuggucuugugcuccugaccucaggugauccacccaccucggccuuccaaagugcugggauuacgggcgugaggcaccgugcccagcguggaucauguauagucuugaaaaucauaguuaggacuuggaguuugaacuggagugacuuaaauguuaaugggaucacucugagaguuguguugggaguagauuggauaugggugaaguaggaacagggagaucagcuugcgggggucgcugugauggcagcaggagguuauguuuucucggaccagguuguggcagugaggcccgcucagauucuagguaugugcuugaagguaaagccagugagguuugcuuagauuggauugggggugagagcaaagggaggagucacggaugaacaugaccauguuggugugagcaauggaagaauggugcagccuuuaccugagaugggaauggaugguggaaacacagauguugggaaggggagaucugaaacucaguuacauagaaaugauugauaagaggccauguggaguagaaaacuggauaugcaaguuugaagugcgugggagaaaucuggucuacagauauaaauuuaggauucagcaccauauagaggauauuuaaagccaccagacuggaugagagccccacggcaguaaguguagagagcacaggucaaggauagcucuggggugcucccuggacucuccagagucaagaaggaacagccaggaacguaggggcaucccugaagccaaguaaggaaagccuuucaagaagaaaggaggaaccaauugcauccaauacuguuggcaggagaauggcgcaguuaagaacacaauuuacagcaggcgacagaaaacccaaccaguggacauaaaccagaggcuguguguguuuauuccucgggagggcuagaggcaggcuguuccagguuugacgauucauaaauguccucuuucugccucuccacucaucucacaucagcauguggcuuugucauuggcuuuucaguuaaaauauggcugcuaggaguuccgugugcaucccaccacuuccugugacugcauucaaaggcuggaagcaaaggacggcaucucagggcagggaccuccuccucucuuuguuuuucauggggacacccaugcagcagcucccccuucgcccucuuguccuuaugucugauggguacagaccagaucuggcucuugccccuacuggcaugaaagguuggaagcaaguauuugacuuuuuaaacucuucuaugggguuaagcaauggugauggggauuaggaaugacaguuggcucaccaggaaagguguuagacacagugagguuaaauaaaagaauaauaauaaaaguuaucaacucuuuguauucauuguuucaucaagagcuuucgcucacuuauauuugggggcauaggauuuuuuuuugaucugcugcuguucauuuccuuugccuguuguuuuuaugucuuuuuauuuugcauauggugauuucuuaauuuuuuuucacuuuuauguugucaaauacauuguuuccuuuaacuuuuccuguguuuuuaugcauaauaagacggucccuacucaagaagacugaccuauguuuaauuauuuuuuuuaugguuucaucuuaagcccuuugcguuguaauccaauuuaauuuauuuugguggauggcgagcgcugacagcuaauauuuguaugguacuuugugccagaugcuguucuaagcauuuuaaaauuauaaauucauuuaauucucacaagaaccuaugagguaaggaguacuccuaucacccccauucucacauaugagaaaacagaagugcagaacggugaggaaccugcucacuaggcagugugagguggcgccggguuugaaccuagacgaucuaccucgagauugucaacuauuaacuacuguaccguucugcuucucaaauuuuaauuuggcaauucaaauaucuuaauaccacaaauaaguauguuuuugcugauuuaagauaccucccuuauccuauccuauccugaauuuuuauaucucugagauguauauaccaccguauuaaucugucaguaugguuuuauuccaguaggacuuuuauuauuuuauaauaucuuacuccaacuaguugcacaaguuccuuguuuuuaacuuaaauuguggcaaaauauauauugcacagaaugugccauuuuaacaauuuuuuaaauguacagcucuguggcauuaaguacauucacauuuuuugcagccauccuccauauccaucuccagaacuuuguuuuccccccugaaauccuguauccauuuuacuaacccccaguucuccgucucuuucagccccuggcacucaccacucuauguucugucuauaugcauuugacuauucuaguaaucaugaaagagaaucauacauuauuuauaacuggcuuauuucacuuagcaccguguccucaagguucauccauguuguagcaugugucaacuuccuuuuuaaggcagaauaguauuccgugguauaucuguaccaccuuuuguuuauucguucaucugccugugaacaguaggguugcuuccacauuuuggcuauugugaauaaugcugcugugaagaugguuguacagauaccugcucaagucuuucacuuuuuuuuuuuuuuuuuuuuuaaagacagagucuugcucucuugcccaggccagaguauaguggcaugaucucagcucacuguaaccuccaccuuccaggcucaagugauucuccuaccucacccucccaaguagcuggaauuacaggugcccgccaccaugcccagauaauguuuuuuguauuuuuaguagagaugggguuucaccauauucgccagacuggucucaaacuccuggccuggccuccggugauccccugccuuggccucccaaagugcugggauuacaggcacgagccaccacccccggccugcuuucacaucuuuuggaucuguaccuagacaugcaguuguuggauuauaugguaacuucagguuuaauuuuuggaggaaccaccauaccauuuccacaguggcuacaccauguuacauucccgcuagccuugcacaaggguuccaguuucuccguguccuugccaacacuuguuaauuuuuuguuuuugcuuuuuuuuuuuuuuuuuuugaugauagcaucccauuagguacaaagugguaucucgcgcgauugugauuugcauuucccuagugacuagugauguugagcaucuuugcaugugccucugggcuauuuguugucuucuuaggagaaaugucuauucgaguccuuuguccaguuuuuaaauuggguuuuuugguauuuucguuguugaauuguagucuuaauguuuuucuguucuaaauuuuuuuuuggcuauucuuaauuauucuagauuacuuuaacauguuuuaaaaauucaauuccugcguuuaaaagcaaucacauguagguucagauugcaauagcauuuaauaagauaucaauucauggaagaauucacauguguacacuuguucagaacuuuuauuuuucucauuuuuauaauuuucacaauagaauagcacuuuuuugauaaauuuauucacagaaacagugcauaugugugugucuaugugugcaauuccuuuuuguuaccaaaguaagggauuucuuuuucuguuuuuuccuggcacauaggaaauauauggauuuuguauaauacuuauuugguaagaagcccaucagguuuauuuaauauuuauacagugauacucuaccauugaagcuaaguucuuaaacauguauauuuaguguuggugagagaauuuggucccuuaagcuuaauuggaaguggaccugcagccacgguuuugaguauguauaauuuauuucucuuauaacuuguuaacuuguuugucacuuuuaaguuuccccugauuuuauaauaauuccuaguuacuguagguaauuacucuaaagguaacugucucuaaguaguugaguuguauuuaaggaacccaaguuauauaauuauagcuacagacauauucucugaauuaacuggaaaaaaaauacauauucucaugucucguauuuuaacugugucuguuaguuuggcauuuucucuuucuuacuuaguaguuaguggccuugccacuugugugccauacugauauauuucaaauggaccucaauaaucuuuucauuuuuuaguuaaaauucucacuucucuaacccuggcaggugcugguacacuagcuuccuaucuuuuucccugauuucagucuucagucaguucugcacacugcuaccacacaaucaaguucugauguaaaugcuaaaaaagccucacccuccccgacccccccaacccacaucuucccaccauauccaucccuaacauuuaaggucuaaaauuaugagucuggcauucaaugccaugucucacccaacuguaaacuaccugccucuccagccuuauuuucuucuucccaccuguguuccuacuaagcuguauaaacuacagaacaacauaccuuauggugagacaugauguuuucuuuaguuuacaguuuuuacugagaacgucuaauucuguggcaggaugucaggugguucuggcucuguauauguuugaacuuugugauuacuugcacuugccuuacuagguaagcacauaaauacuuguguaagacacaccuucaugugaaucuauuguccagauuuuuauuaagaugaucuguuuuggccaggcacgguggcucacaccuguaaucccagcacuuugggaggccacggcaaguggcucacuuaaggucaggaguuugagaccagccugaugaaaccccaucucuacuaaaaauacaaaaaaauuagccgggugugguguuguguggguguaaucccagcuuccuacaacacaaguugugcagcacaucuguaggacguauucaucuugcauaacuggaacuuucuacccauugaacaacuccccauuucccuuccccaccagccccuggcaagcgccauucuaccauuuuguuuuacagaauaggauaauauuaauauuaacacuauccuguuguucacuuaaucuuuccauugaaauuuuaguuuugcuaggcgucuuuuacugauuuuuauuguuguuaaauauaguauacuuacucagguuuucugaggugaguauuuuaguaaauugguugauuagugaagguuugcuucaaauccaauagacuguguuacuaucuaaggcaaaguggagguguuauuccuuccagauuuucccuacauaaaagaugguuauaauuacagaauaaaaaccaaucuguugucuauacguaagucuaugcuaagugcacgagcuuaaaauaaaccacugaggucaauaauauccugcaaguagaucuuaaaucuuuaucuuucucaucugggauaaguuacacaauacgauaugaccugguaaaugucaccuuuucggaacuguaacucagagaaguccuguauugauuucacuguuuaagaauuuagcgccuguguuacuugcagucucucaauuaaccuaauauugcuauguuuuaguauugccaacuuuaccguuaagcuaaacgucgggacuguuggugaaauaguuauaugucuuuguugcauccguacgguuuucaccauuccgcuguaggagcuccuguccaguaagagcuccauucugaacucugucugccuccaagccucauacuuuucuuuaacugagauguuucuauucuguggcauggccgagggaacacugggcaggugguuagacacuuggauucuaggccuuacugucacuggccggguaugugacccaaguaagccauuuaaccaccuaaguagucuucucaucuauuaacugggauaguaauagucacacacuguuaggauuauucuaucaaagaaacuaaucuuuuggugaaaucggcauucauuauccucauugcucauuagucaagagccaugguggaauugggaagacuuuggugaggacuggcugccauuagguguaggggaugggccuggaugggggugacaaugagauaggggaggucagggaaaugauauuugguugccgggguaagcuuuccucuagugcagcugugugaagguacaggucuucuguaguaauucccaggcacacucagaaaugucugcaaaccuaaguuguguuuagaaacaaagcuaugaggcaugcauuucugaagaauaagcugauuuccaaaauguaggaagccuuggcugcacuguggcuguggcccagucauuuugaucuguuacgugcccaaccuugcuuauuaguuuugaugaugacucaucaguguuucugcugaaggggcggcaauuuggcaaauuuauauucuaaaaaucuguuuuccuguucuuccuaaagcaaguaaaacugguggcuaaccauaaauuuuuaaaguguguauuugcuaucuaacaguugcuaauuauuguaaaggauguaaagaaaaaagucucuaauagacugaagauucaaauaagcuuguaaaaauggguuaagcacugaaugcuucaguauagaugaugggagaacacauuaucaaaauacaucauuuacuguuggcauuuaaaaaaaugaauuuguugaggaaacauuuauuaagucucacuccaugcuagaccuuugccaguuccugaggaccagaauugaaucaggugcucuuccugaucucaggaaccuuagagaugguccaagaagaauguggaggcaaaugcugugauagaaacaaguacauggugugaggagaaagcaaggcuuaguccacggcauucagagaaggguguccuggcaggauaagcucacagagagguccugauucucaacagugcuucagaaacuccaggugcauuuuaaucaccuggggaucuugugaaacugcagguggugauucaguaggccuaggguggagcugcaaaugaguagcaaggguucagaagagaagcuugagcugacuuuggauucacuggacagaaauaggggaggggauagaaaggaggccguucagucggaaggaugggcguaagcagaagaauagagcgaaaugacuggagagaaaccacgaagggguguguguguaugaagggguagaggcauggccugagggggaagaaguggguagggaucaaccccacauugccuuuuaagccugugaaauuaaauauuaaauaaaaggauugaaacuacgaucaccauccuauagauuggggugugcaaucuuuuggcuucccugggccacauuggaagaagaagaauugucuugggccacacauaaaauaugcugaugauagcugaugagcuaauaaaagaaauugcaaaaaaaucucauaauguucuaagaaaauuuaugaauuuguauuggguuagcguucaaagcugugcugggccgcaugcuguagaugguggagaaucccaaauuuuagauugggucaugaccuuaauuuucacauuuaggagauuaacaugauggaguuggaagggauggaaggacaggauuuuaggaguccaauacaguuuagacaaugauauaaaggguuaaauaaggauucaaaggguggaagaagagcucuuugaaaagaaaugaugugccuguuggaauauuaauagaauagcacaugaugugcccuggugucagagagaaagcgagguuaaucggagcagagcacacauggauguaggagagccauacaagagugaggcuggagccgaaggaggggagcuuaaugugguaauuucaaaugccaggccugaggagcuucagcaucuuuuucuccauuaggaugagguuuuuaugagcaaaaucgcuagaacaaagcaaugggcauuacuuuccagcagcauuauuugacucacuuaugggauccuuagugauacgcaacaaugucauuuucaucaaaggucuuuuucaacucuggguagucuucaguuaggugguacugguagcauugggagacagugcuagaauauauggggaucuggggaagaaaagaugauuccaaugguuugaagcuggaaaaaaauaaaaaauagggcuauauggcuggguggggugguuuacaccuguaauuccagcaguuugggagacugaggcgggaggacugcuuaaggccagaaguuugagaccagccugggcaacaaagcaagauuuuuaaaaaaauaaaacaguggagcuauaauuagcauaaacaggagcaugucggucuaagaugaaaaccuagaguacucaauaaguacuuuaaaacaugaguagccuugagauucagaaggaagauagggcugcaggugagaacaugggauucauccgcauaggacaaugguuagaggaaaguagagaaaauagacucuccaagagaaugggcaugaggaggguuaagagcgaaagacugggcuugggaaaugcccauauuuagguagcagguucgugagcaucaggagaauguaguuucagagaugccagaggauacgcagccuguauauuuauuucacugauaaguggaaacauuuuuacugcaagaaagaguugcaaguuggagugaagaucauuuaaguuuggcaaauaaacuguguggggaguaaagaagaaaaggugagauuaaaaaaaaaaaucuuaauaguauagcaccaccugguguuagaacauuaggcauuuuucaaaugaaauuuuugcuuaucaaauugcauuuuucuuccuguuugggugauuuuaaaauuuuccacucaggagaauuuuguuaaaguuuucaguuaacgugaguucuguuuucuguguauaaaugagugaauuuccugagaucucucuuucauuccaaagauguauuuggacuugguucuuauuuauuucuuauaugauagccuauuguccuaauggauuauuuuuuuuuuagucaccaguauggggggucguaucaauuuguuuauuuuuuuauuucaguuuugccaaaagcugcuuucucaugauuauucugauugaucaucuccuucagagaacaugugugaguuaauuacuuuaggagacaggguuacuccuacacuucucauauccuaauugccucaucauuucugcucucuugccucuaaaugaucaaaaauaaacaugucugcgugaagcuuucaucuuucaucugaaguuacaugauugugaacauucauuuuguguuuugacuuuguuguuagugcagaaguuugaguuuacaggcuuaaaaagugccagcuuucgggaugaauagcacuggaaacuuuuuguuuuuuuuaaaccccaaggaaagccuacauccuugaaaacugcacagucgucaugggugaauuugccuagaccacuuccuaaauccaaagcaucuuugaaaaguccugcgcugcggaggacaggaagcacccccucaauagccagcacccacagugagcugagcacuuacagcaacaauuguaagucgacuuuauaucacacuucggggguuguggaaacagucauuacaagaaaaacuaaugcucugcaaauaauuagaauuuuuguuucugggguuucaggaaaaauaggcauacugcuuccuuggaguugcucugaaaguuuggcagaaaaaaaauucuuugaaaaacacucuugaaauaauuauguguuaaaguauauuuuugcaugaaggauucgaaagugcaucgucugaagugaugguguuuuggagguuuaagaguagcaacccaggggauuuggacucuaacuggaaucagaaaaaaagauuauuucaguuucauuuacuuugcaaaagacuaucuccuguggaaucuuuggaugcuagauuuuguguaauaggacuaauauaacuugaauccuaauucuaaaaaauugaaacucaggagaauuuuguuaaaguuuucaguuaacgugaguucuauuuucuguguauaaaugagugaauuuacugagauaccucuuucauuccaaagauguauuuggacuugguucuuauuuucucauuuccuuuuuuauacuuccccacgaaauaauucauaaauuuaaaccaucuuggagugcccgcugugcacagacaccaugauaggcgcagugaggagcacaggauauaaaagaaauggcccuuauucuaaaaaauaguugaggagaaaaagaagguauuuucauggaugaugagaauaccaauaaaaccagacacaaggguguggagaggaguggcgaacugaucucuucaguuugacagaucaguuucuucuuuugggugaggaguuggggacaaaguguaauaaugcucaugaggcuccucuggguguggagcaguacuuuaggauguccauauuugcuuuuauuuuuuucucucagguaacuucugcuguuacccugauauuuauauagaaggugauugaggcucagagauguugucacuggucuaaaaucacacagcagcuaugugagggaauugagaaugcauuuuuuguagagaaggcauugaauuaaugaccgaauuaaugagcacauuuccgacgggucaccuagcagcaguagcuggacucauaugagaguaaguagcugcauacccuggcacuucaggaauacugggauaugugacuugcaauuaaacaggauuguuaccagcuuuacuguuggaauuuugaagguguggcacaaaaucaggcuugcauguaagagggaacucugaauuugaaaagguaauucacacguguauuauuuuaagcucucuuugucuugcaaagcaauuuuaaagacaaacugccaaaacagaaucaccaacaugcucuagaaaaacuguuguggcaacagaauuuguggcacuugaagcagacacagucuguagugccacagccccguguuuuccaucgacauccauguugacuuggccaccguuucaguacugugucugaugcuccuaaggaggcuguaaagugcuuuuguccauuccuuuuugucuuuuaacaaagggguuuaccauacacccacagagccugucuaguggcgauguguuccuguugcggauuaagcauucaaaucagugagucucuuucuuaguuugauuugcuagcugguuuaaucuguuuuguguagugccuuggagcuuacgcauuuuuuuuuuuuucccuccauucgaauucacuaagagcaagcaugagggauaugagagugaacauggcugcaguuuuuccugcuuaagcuugcuuugauccuuuuaaaugacuguaccaggaggauuucgcaguuguacagaaacugauauuucuucaaaaaucuuuaucaauucuacacucaccccaccggcugguucagagaggcacuaugaugcuaccuuauugacacugcuggucgugggaucguacagccuuuguauaauuccuuuguuagccacguuuacugggaaaaaaaguaggucgacgauuucugguuucuuuucuuuguaagcaugcuuaaauuuuuauucaauaaauugauuuaggaucucuugacuucuguuuuuguaacuuguaauuuaugguaaugguaguauuugggggcauuuuguauguauauuuaagaugugaaugcuucuguguaggaccaauuuuguugucucuuuuauguguuuugcacucuuaauauaauucagcagcaucguuaauguucuggcacaugaaauuauccuauuaucaaagacuuuuugaugguuuaauuucuuaugaaauaacuaguuuuuguguguauguagcugguaguugugcaaguguagaaaaauacuuuucuaaaauuaaaauggaaacaucacaucuuuauuuuccuaaguuguaacugaaaguauuaaacauguauacuuuuaaaggcuaccucaaaacaugaaaaaaucaucucgcgcugaaaauuuccuguuucugauaauggguggucauguuaagaauuaacuuccucuuuugaucaguguucugauuuauacuggcuuaaguauuugaaucccuuuaacaaauauugguuucucgcuuugucugcuuguuucuuugugaugugauaucuuuaguggcaucauuuaagaacuucugauauaacacagugcuguuguaaaauuagcacuggguucucggaacuuugggauccuauagaaauaauguuacuaaauuuuuuaaaugaccaaaucaaaauacguaaggcaauaaauuguucuuauuugggaauuuuagcagguucuuuguguguguucuuuuaaguguagaaaauuucaaaguuacgaucuugauccuuuuggauauuaguguaaaacauuucacaaugguuucuauaccaaaugugcucauuuauagagguuaaagauuauaaggucuuucacacucagauaccuaauauccaguuuuuaagaucauuaaaguaacuggguaaaaauaaaugauauauuguaugucaugaacagaguugaagauuuggggacuauugugcaauuuagaagggggucuugggagaguguauaacuuugcgauguuagcaggaaaguaagguccaaagacauuacuuccucuuccacuuuggccacaaaaccauguuuauauuugagagccagaugguaggggaaauguaagaggugcagaccaaagcuauuugcauucuccuggaaauggaaggaacagaaggagacugaauaaaagaaauggaguguucuuucccuucaccuucacugacagcccuggcugagugggguguaacaugcagaaaagggcacuaaccuuggacccaccuuaguuuguuuuuuguuuuuuguuuuuuuuuuuuuuagauggaguuucgcucuugucgcccaggcuggagugcaguggcaugaucucagcucacugcaaccucugccucccggguucaagcaauucuccugucugaaccucccaaguagcugggauuauaggcaugccccaucaugcccggcuaauuuuuguauuuuuaguagagaugggguuucaccauguuggccaggauggucucgaacuccuaaccacaagugauaugccugcgucugccucccagagugcugggauuacaggcaugagccaccacgcccggucccaccguaguuuuccuacuaacucauguuaaguuggacuaucuuugucuuuucuuagccuccagccuccauacucuccucugaucaaugacaagggaggacugggucaucuucaaaguccuugcagcaacaaacauuucugacccuuuucacugcaauaagacagggccucauuguuuggcaggaugguguuuugaguuguucaagugauuaagcugauaaagaauaggguggaucuuauuuacccuuaguuuuuuguuuuuuguuuuuuuucuucucucacaacaggaaugggaagugaauauugucucaccugccaacacugguuaguggccaacacugguuaguggauaagaauucgccuguaggauggugucagugguuucucagggugccuccagguucagagggaaaguuuuguguucaagucgugaugucugucaugggugaggcuaagaugaggaacaggcgguagauucauuaggcuccacaucacaaaacauguuaguacuuacgcacuucugaauggacuauuuaaaaaggaaauauuauccagaccacuguuaacuuuguucucguucuuucucuguucacguuuuucuaggguauaugugagacauucuuguuauuauauaguugagugauauugcuuuugaaauucaaaaguuuagauuucaguaguacuuugauuuuaagccaagugggcagaugaucuggcacaguggggaguguuaaacugauucacauaaaauucaagaaaugaacagaauguuggcucuguguguauauacauaauguaauaaaagcgaauuuucacuagguguuagaauguaguaugaauguuaguuugcagauaaaagucugaaacaaugagaagcccuuuucuuuuuuuuugagacagagucucacucuguugcccaggcuggagugcaguggcacgaucucggcucacugcaaccuccgccuccuggguucaagcaguucucccaccucagccuccugaguagcugggauuacaggugccuaccaccacguccagcuaauauuuguauuuucaguagagacaggguuuugccauauuggccaggcuggucucaaacuccuggccucaagugaucugcccaccuugucuucccaaaguucugugauuacaguugugagccacugugcccagcaugagaagcccuuuucuaauaggaaaaucaugucuucugcuugggcuuuccugagaauaucccuuaguuuuuccuuuuagacucaccagcuccuuuauuucacuugaaccacacuuuggccauggggaaaugaagauaaagauuccagagaaucuguuauucuggcauaauugagacaguugggaccaaagaugacaaaggggcaguuuuaaacuacauauuagaucagguugagaaguagguggccacaugaaaaauuuuauguauugucucuucaagccagcaguguuuaguguccauggcucucuagaacacugucuuuaggaugauucugaggaugcauccagccucagugggacugaauaccacagugaguugugaaggcaaaugcacugucuauucccauacccgauaugggcgaaugcacugucuauucccauacccgauauucagacccuuguuauucauagauaggugauucagcacagcuaggcaguggucaagucagcaccagaacuaggauauuuuacauccuguuccauugcuggaaacuauuaugcaucucuuauauuggaauuguugccgcugaggacuuuauuguuuggauauaaugacucuggcugagggaaaauuuagauagcaucaggauacucagucaguugccauguuaggaacagaaauagagggcaggggaaauauuugaagagcauuaugacucauggugguauacauccuucaaguugggguuuacuggaaagcagugggccagccuagaguacaguaaguagaaauugagagaaagauauuguuagucauaaaauuauguucagcucaguacagguugugccugccauuaguaaagcagaaagcagguacaaucguugaucauagaguauaugaauauguaucuuguauauauagcuuucauguaaauauguauaaaauauaaaugcauguguguuuguaccugagucaaacgcagacauuuuauccuugcaguaugaauucugacuucauguugcguguuaugaagcugaugauggguguggugccggguugaucuaguguuguauugagucugaaaaguggcagugagacagcugauuuccagcacaccaccuccuauuuugcaugugacagagaggcaagggacacaggaguaccaucccucaugaagaaccuguccuuuacuuuagugaaaaucuuuuuacugaucucuuugugaaccgugggccuuugugucucuaaauuuuagaaaagaaaagcaugaauuuagaaucauacaauugcauauuaggucuguaaauugaacucaguuuaauuuuuuaaaauaugaauaagugacuuauuuguugcugaauauaaucaaauacggcuucaagaaaaguaagacuaaaauccagauuguuauaauuccaugguuaagacugucuaauuuucuuuguuggauuugauucagcaaaagcuaaaaugcuaauugaaacccaauauccauuuucuaugaacaucuaaaaaggguucuguugaauguuguaauggcggugucuuuaauacugucacucccauuagcuuccugucaacuuuggaaaagccaagucucuagguucuagggaaggugagaauuggaaaaaaggacaggaaauugacagaauuuucucagcaggagggaaagcucuguguugauuugaccuaauauuaggaauguuauuugggcacgagaacaaugaacagauggcucauuguacagggccuggguguggauuaggggaaaauaauagcacgccuguacaaaguuugaaugugauguguauaagcacuauuguagcaguuggaauagguuagccuagugaaaaauuucuagcugucuucacauuuauaaugcauuuguaaacaagguagguaucuuaacccuuugcuaagugagugaagugagaaaagggaucauaguugguaauaaagaaauuuauaagcguugaauaguagaauagaauugggugccuagaauuggauauugaucauuauuuggaaacaaacaggcuaggugcgguggcucacgccuguaaucccagcacuuugggaggcugaggcgggcagaucacgaggucaggagaucgagaccauccugccuaacacagugaaaccccgucuccacuaaaaauagaaaaaaugagccggguguggccgcgggcgccuguagucccagcuacucaagaggcugaggcaggagaauggcgugaacccgggaggcggagcuugcagcgagccgagaucaugccacugcacuccagccuggacgacagagugagacuccgucucaaaacaaacaaacaaacaaacaaacaguagaaaauccagucuggauugguggaggggaaauuuuuacacauaauauaaaaagaugguuuuuguuauugagguaagauucccuuuuauguuuuugcuuuggagcuaaaacauaaaguuuacuuuggaacaaacuuccuuuguucagggcagaaguuagcauuuuaacuccuugcuguaggagcaaggauuugaaccagagcguguccuuauagcuaccaaggagucuguauguuacuguucuugugucauuaacuagcugacugugcgaauucuuccuuguccccauggagaugggugcucuuccuagcugcaccuggggcauucuuguuacauagcaugaaguggcuguauuauuucuuccccaacucuuaucugggaugaaagcugaacuggacaagaugcauaagcuuggacugugccaggcuaaccaggauguguggucacucugauuauagccuuuauuucgcaucccugagacacaagcuaccuguuauccauguuguauucccaauguucaguaaugacuggcaugucguaggugcuuauugagcauuuguugguucaaggacaaaggaauaaauguggaaggucgaaacuguguuuaucuauacaauaaaauguacuuuucuguuuuauuacagcugguaaugccgcugucaucaaauaugaggagaaaccuccaaaaccagcauuucagaaugguuccucaggauccuuuuauuugaagccuuugguauccagggcucauguucacuugaugaaaacuccuccaaaagguacaguccucauugugguuugaagagggagggcaagacgcuuaaaguccuuggcuuguagaaaguuaaauuuugacaauuagguuuaugguauagucaacaaugauuacaaauauguugagaaaggagauauaauacauuuuugcacugaggaaauuguuuuucugacaguugguagguucuauaguuaaaaaucauuacguguaagucagcaggcagaacaaagguauaagguagaaacagcaaaacuucaggaguuaaauuauucuaaaacagugcucuagaauagugagaaaggaguagaaaugcaugauuacuuuucaucaggguagauguuuuauguuuauuacuguacuugugucuucaugucuuuggucuaagacauuguucuuccucuaaauguucuuuaucucuguuccuucucauaucccucacuuuuuauuugcugugauuaugaaaaguaauuuucagguuuacaaaauaugugguauacacuuaaugugcaauguuuucaugcagcuuugucucaguggggccaaagcacaucagaagccuucuuugugccacaugcgguggcucacgccuguaaucccagcacuuugggaggccaagacagguggauugcuugaggucaggaguuugagaccagccuggccgacauggcaaaaccccaucucuacuaaaaauacaaaaauuagcugggcauggucguguguaccuguagucccagcuacucaugaggcugaggcaugagaauugcuugaacccaggaggcagagguugcagugagccgagaucgcgccacugcacucccgccugggugacagagugagacucugucucaaaaaaaaaaaaaaaaaaaaaaaaaaaaagcauuauuugugcuuagugaacugaagcuuaacuaaagccugagcgaauaauugugagugagaaacuugaccuauaaaaugagacccacauuuauguuagagaauuuggaaaacacagaaacaaagagucuuccuuaauucugucaaccagcaauugcugucacauuuccuugugacuuuuuuccucuguauguauauguuguuuuguuuuuauuccagcaaaacugagguaauaaugaauauacucuucuguaucuugcuuuuuauuaaguuaguaguguaucaggagagcuucuucacuuuaaauggcuauucuaugguuguccacuucaguuuauagugggcaacuucugacuuuuauugggguuuauuaauacugagaugaaccucuucaaaugugagucaagauucauuguuucagauucugguuacuuguggauaucccagaaggaggaauuacuggguuaaccugcaugaaacucuuuggauuguuaauaucuauuaguaacuuucucagagguguuacucugucacagcauccuccuuaacaugucucucucucucucuguguguguguuuaaaggauaauaugguaccuugaggcugguuaauguaugucaauaccuuuucuuuguacugaauugaagagaaaauaggcaugaauuuuaggaguggguugaauucuucagugugcagcagguugucauuugccuagggaguuaaucaaauuucggaggcaccaaaugaccucuugcugaguugacaucagguuggaaaacugugguuuuuuauugaugaugauaaagccccaugauccacacagcaauaaugaaguuaacgcuguugaacuuugauacuaaaauaacuugcagagaaugagauuccauggacagcuuuguagaacaggagacucagaauucuaaaaugccucacuauugaauggauagguuaugucgcaacaguuuuaccugugugggaaucagugcuuuccauugauaacagccacguauuuuaagagaucaucaucucuguaaaauuucagauagaacaugguagcuguucuaacugguaucugcagaugauuauguccuagaaacaacuauuucauguuaaguagaagcaucauagauuucuuuuagugacuuacagcuguguaccuauuaccccuccugauuuuauauuuuaucaguuuggaggaaaaacuucuauuuuucuucauagcugaauagaaacggguaguuucggaaagcacacgggagugacuguccuucgugaagucuggccucugcucucccggcagcagaauggcauaugugcacagucugugaauucaguacuguuaaaacuugaacuucagcuguucuugacugaaaaaauacugcggcuuuuccuuuuaaaacugguccuauuuaauuuguggugacuucauaucauacuuaaacauuuugauguuaugugaaauaucaccuuauauuuaaaaugcacuugacaaaaguugguugaaucucggugauauuucccaccgggaaccugaaauguagcgauugauuguuuuugaaaauaauucuuaucaacaugguuuguuuuuaugugauaugucaaauaaaacauauguauuuuacauguuucuuuuauaucuuagguccuucgagaaaaaauuuauuuacagcucuuaaugcaggugagugaccacuuuauggauggcgauaaaaagaaucuuuuuguaaaguuauguuacuacaaguauuuacagugauuuuuuacuggugugcuuauaaguagaauuuccaauuugagguguaaaccuaacuuuuuaugacgggucgcauagcauuaaaauacgguaagcaugacuggccaucuaaugcaugaaaggacauuguauuacuaauagauaguuauagucuuuuaaaaaaugauuuuguuaauguggucuaaaugaaauggaaaauguacuucccccaagaucaaugcuauuuugaaauuggauauuccuuaauuuuuaaguggucucaauauuugguuuuagcaccuuuucccaguucagcagccuauauuuuuauguuuuuuuuuucacacuuucacuggacuuaacauucccaagauagccugcagccuccacuauuugaaccacagcugagaauccaaaacuuuaugucucucaagaacccauaaaagauuucacaaaauaucuucacugcgauuccuauacuuuggauggauggauggauggacagacagacagaccgacagauaggcugggcccaguggcucacaccuguaaucccagcacuuugggaggccaagguggguggaucacuugaggucaggaguucaagaccagccuggccaacauggugaaaccccaucucuacuaaaaauacaaaaaaguuugccggacguggugguacgcuccuggagucccagccacucaggaggcugaggcaggauaauugcuugaaccugggaggcagagguggcauugagcguagauuacaccacugcacuccagccugggugacacagugagacccugucucaaaaaaaaaaagauagauggauugaucucucuagauagauaaggucuccuguacacugccuacauugucuuauuuuauauacagugauaaaacaguuaugugccuucuaaauccauggcagauuagaagagcaaaucagaagaaacgaagguacaagcaucgcucauuuucuggagccuugcaaauacugugcuuuuugcaacucuaccagcaucauuuuuccaacagcaguugcucacuucaugucuguguguuacauuuugguaauucucacacuauuucaagcuuuuucauuauuauuauaucuuuuacggugaucugcgaucagugaucuuccauguuacuguugugauuguuuugggacaccauggaccaugcucaucuaagacagugaacacagcugauacguuugcauuucaagugcuccacugacuggucccucuuccaucucucucccuuuucuuggucuuccuuauucccugagacacaauaauauugaaaguaaccaauuaauagcccuauaaugaccucugaauauucaagugaaagaaaaguugcaugucucucacuuuaaaucaaaagauagaaaugauugaguuuaaugaggagggcacauugaaagccaggauaauucagaagccaggucucuugugccaagcaguuagccaaguuguaaauggaaaggaaaaguucuugaagaaaauuaaaagugcuccucuagugaacacucaaauaagaaagcaaaacagacucccggcagagagaaagucugaguggucugaccagaagauuaagccagcugcaacuuucacuucggccaaagccuaauccagagugagacccuaacucucuuuaauuguaugaaggcugagagaggugagggagcugcagaaaaaaaaaagcuggaagcuagcagagguugguucaugagguuuaagguaacucuucauaacaugaaaguacagggcgaagcagcaagugcugauguagaagcuacagcgagucauccagaagaucuagcugggaucauuugauaaagguggcuacacaaaacaacagacauucaguguaggugaaacagccucauauugaaagaagaugcuguuuaggacuugcacagguaaacaggagaagucagugccuggcuucagaugacaagcugucuuauuagaagcuaauacuucugguaauuuuaaguugaagcugacguucacuuaccauucugaaaauucuagggcccuuaagaauuacguuaaaucuacucugccugugcucuauaaaugaaacaacaaagccuggaugacagcguauuuguuuacaguaugguuugcugaauauuaagcccauuguuaagaccuacaacucaagagaugucuuucaaaauacuacugccgacugacagugcaccuggucacccaagaacucugauggaguauaguauaguguauuacauaguaauauauaguacaagaguauaguacaggaagauggauguuuucacaccugcuaacauagcagccacuuugcagcccauggaucaaggaguaauuuugacuuucaggucuuacuauuuaagaaguacauuguguaagacuguagcugcccuagauacugauuccucugauggaacggggcaaagucaguugaaaaccuucugaaaaggguuugcucuucuagaugccauuaagaacauucgugauucaugggaggaggucagagcaccaacgugaauaggaguuuggaagaagcugaccuaaccgucauggaugacuuugagggguucagugcuucaguggaggaagucacugcagaugugguagaaauaggaugagaacuagaaugagaagugaagccuaaggugugacugcauugcuguugaucucugguaaaauuugagcagaugaggaguugcuucuuaugaauaagcaaauaaaguaucuucuugagauggaaucuacuccugguaaagaugaugugaacacuguugaaaugacaaaggaguccgaauauuccauaaacuuaaagcaguggcaggguuugagaggauugacuccaauuuugaaagacucucugcuguggguaaaaugcuaugaaacagcaucacgugcuacaaagaaaucuuucaugaaagagucaauugaugucgcaaacuucauugcugucuuacuuuaaauugccacagccacccaaaccuucagcaaccacuacccuaaucagucagucagcagccaccaacauugaggcaagauguuccaccagcaaaauaauuccugcucacugaaggcucagaugaucuuuagcauuuuuuagcaaugaaauauuuuuaaauuaagguguuuuuuuuuuuugagacagagucuugcucugucgcccaggcuggagugcaguggcaugaucucugcucgcugcaagcucugccucccggguucacgccauucuccugccucagccucccgaguagcugggacuacaggugcucgccaccaugcccggcuaauuuuuuguauuuuuaguagagacgggguuucaccguguuagccagauggucuccaucuccugacuucaugauccaccugccucggccucccaaacugaugggauuacaggugugagccaccacgccuggcaaauuaagguauauauuuuuuuagacauaaugcuguugcacacuagacuauaguguaguguuaauauaaguuuuauaugcacugagaaaccagacaauuuuugugauuugccuuauuaugucaugugucuuauggggugauauauaucucccagguaugcauguaauguuacagaauguugacuacaguuuguucacacauugugagugucagguguuaaggaugcaguccugagcgaagaaugagcaggggccuugucucuggagagcuaauaggauaguuaaaaaaauaaaauaaaaaaccugcucaaauagacaugaaucacaaaugcacugaguucuaggaaggaggguugucuuguccuagaagagagguccggauugaaggcugucaugugagggaaaccugggcaagagguauaaauuucugagccuguuguguaaagaaaacagggugggauaacauuacaucaugaauaacaugaauaacaaauauccuugaugccccaucagguguauucaguuuccucaguguaauaagcagggaaguguggggaaauuaucucagaauucuuuuucuuuuuuuuuuuuugaggcagagucuugcucugucgcccaggcuggagugcaguggcgcgaugucugcucacugcaagcucugccucccugguucacgccguucuccugccuuagccucccgcguagcugggacuacagacgccugccaccaugcccggcuaauuuuuuguauuuuuacuagagaugggguuucaccguguuagccaggauggucucgaucuucugaccucgugauccgcccgccucggccuccgaaagugcugggauuacaggcgugagucacugcgcccagcuaucucagaauucguaaccuuuuguaggcucuuaaagcuaggaagacagccaugcagaaugaucuaaguucuaaagauccccaggaugcugagugugaauauaugugguuacuaaagccuuuauaggguaaaaaugcagaagaaacucugcuguacacauuuaggcuuuuauuuccuuuuaaguuucugguacauccuaauaucuggggaaaaaagauagcuaauauucuauggaauggcuuuguuuaaaaauuaguuaaccauuaucagaaaacuggcucaauugguagcucuguguuuaacaguuuaagaaaccuccaggcuguuuuccaaaguggcuggaccacuuuauauccucaccaggaguguaugaagaauccuguuucuccacagccuugucaacacuuggcuuugucugucuuuuuuauuauagcuaucccuacuggguaugaagugauaccucauuguuguuucaauuugcauucugacagccagugacauugagugucauuucgugugcuuacuggccauuuguauaucuucuuuggagaagugucuauucaaaucauuugccaguuuuaaacugggucauuuuuauuguugaauuguaggaguucuuguauagucugauauuagacccuugucagaguuaucauuugcaaauauuuucucccaauucuuggguguguuuucacuuucuugauaauguccuuggaaacauaaacguuuuaaauuuugacaagguccacuuuaucaacuuuuuuucuuuuguugcuucugcuuuugguauuguaucucagaaacaguugccuaauccaagguugugaagauuuaagccuguguuuucauuuaaguuuuuuuugcuauucuagcuguuauaguuagguuucugauucauuuugaguuacauuuuuauaugguaugagauagaaggucuaauucuuuuuugcacauggacauccagguguugaagacauguauuucccccauuuaaaugccuuggcaccuuuguuaaaaauaauugguuaagaaugugaggguuuauuucugauuucuaaauuguguucuuugcauuuauauguuaccuuugccagugcuacacugucuugauuaguaaguuuugaaaucaggaugugagucauucaacgucuuucuuuuucaagauaguuauggcuauucugggucccuugauuuucuguaugaauuuuaggaucagcuugucaaucucuguaaugaagucaggugagguuuuaggaauguaaucuaauaauuccaauucuaauaauuucuguuacauugaaucuauagaugacucuguauauauagaauguauucuaaggggucaacauugcagcuuaaucuagauugugugguaggccucuguauuuucccgaaaccauaagcaugacuuucccagguucuucucgaugguuaguuauuaucaugacuuaagacuaaccugguauuaugaggagccuagugaggaaaaguuacuguguggacagaggaccacaacaaaguguguuugcuuuggaaagacgacuuugaugcugaaaaaugaugcugaaaagccagugacuuuggguggaucauugaaccucuuugauaauaguuuucuauguaacugaaaggguggauuucuagauuucucccuacugugauauucugugacugaaaaucaccuugacuuuuuucauauucugcuggaaaugagucauauuuuagcugauacagaagacauugccuccacacauaaacauguuccucugaguguaaauuuuuaaucguuguacuauggcuuugagauauuuuuauuuuaaagcuguaaguagugguggagauuacaguugaguugaccaacuucauauuccuuaguucuaguaaaauaaucacuuuuaauuauagcaguuugccaaacuucaaaaaguuuagcauguaguuuagaaaucacccuucagcuuuuuaaaauuugucguuuuaaaugaaauuuagauaaguguauauccugcuuugucauuuaacauauaguaaucacuuuuacauuuagcagauacaguaacauuuaacuacuuuugaauauuuagggugcuucuguaucacauucauaaaugauucuaugaugaacaucuauacaauuagcacuuucaacuuucaauuucuugugauagauuauuaaaaguaguaucaggaaaucacaauauguacccauuuacagucacuucacucaaauagccaaauuguuuuccaaaagcuucauaucauuuuauaccgugguugacauaaaagacaccuggcuucaucauaccuugggucaacauuggauauuauuuuuaaauuuuuuugacuaacauaauaguuuaaaauguuacaucauuguuuuagcuugaccuuuaucaauuaaagaaauuacauuaucucauaagacaauguagaaaagcaggaggagaacgaacuuuuaaggcacgggauguugguuuaaaccuucguccugcugcuuucuauuuguguccugaccuugggcuaguugcuaagccucuccaagucucaaauuucucguuuggagacaugggaauauuggggaaauaauucccagaaaggcaauaauaugacaucauagaauuguuuuauaaaagguucucaaauaauaguuaagucagcugcuaggaacgguaaugauggcgaucuuuuacauuguuuuuauaauucuaggggcuuauuuuuaggguucuuuuccaggaaguugaauuauuuuaaaucucuaaagcaagcaggaaagacugcuuaaagucaagaaccaaccucuuggggucuaacuguuguaauuuauuuaaacguuaugacgcugcaagauuguaguugauauugacucuaaaaaaaaucuuggcuuacugcugauaaggaagaugucacacauaccacagaauacuauuauuaccuugguucuaccauacacuaaagccacuggcauaccagaggcaucagagcuguauuuauccaguacccugauugguuuacacaagaucaucacucucaggugccagagugucugccuuggaagguagaaaaugcacugguccuuccgcaguuacuuaguaaagacaucacaggagaacagggcggcuuucuugccuucuuuugccaagugcugggaagugguugcaaguugcaaaccugcugaugaggugaugccgaggcugccaggguuucuucuggugagaguagagagaaggcuguuuuuucacuguuguuuuaugauuaacauaacuuucccccuauacuuaaaacacagaugcucuuuucauaugggauacauuuuuguuucaaauugguguuggggguugugaggaguggaucauuuaguaaaucuucuugagacagugacuaccuuuuuagcaggagcuagaucuuuuucacauauauacaaaguauuucagauaaauuaguuuuaaacacacaaaguaauuaaaacacuaagaauauagacuuaaguagaaaagaucuuuccaggaacacuaguauaauagaaacgauuaauaauuaggacaacaaaagcuuuaaaaaaccuuagaaacaggcugugcaugguggcucacgccuguaaucccaacacuuuggggggccaagacagguggauugcuugaggccaggaguucaagaccagcuugggcaacguacugagaccccaucucuaccaaaaauacaaaaaaauuagcugcacgugguugugcacacuuguagucccagcacucaugaggcugaggcagaagaaucguugaacccaggaggcagagguugcagugagcugagauugcaccaccgcacuccagccugggugacagagcaagacuccgucucaaaaaaaauaaaaagaauaaaaaucauuagaaacaguauuuauaagcaaagaacaaacugagguuauauuagcacauacucuguguagagcucugucaaaucagcaagauaaagacaacucuauaauagaagcuaaauggacauaccacccaaagagaucuacagauucagugcaaucccuaucaaaaucccagugucauuuuuuuaaagaaauagaaaaaacaaucccaaaagucauauagaaugacagaggacugcaaauagccaaaacaaucuugacaaagaacaaagcuggaggcaucacaguuccugauuuuaaaguauauuacaacacacaguaauuaaaagaguaugguacuggcacaaauauagaaacauagaccgauggaauaaaauagucuagaaauaaauccgugcauauacgguuagcuaaucuucagcaagugugccaagaauacacaauagggaaaggauagucuuuuuguagauaguacugggaaaacuggacauccacaagcaaaauaaugaaauuggacccuuaucucacacaguacacaaaaaucaacucgagauggauuaaagacuuaaauauaagaucugaaacuauaaaacaccucaaacaaaacauggggcaaaacuucaugucauuuuucuugguaugacaccaaaagcccagguaacaaaagcaaaaauagacagguuggaguacaucagauuaaaaaucugcagagcaaagcagucauuuaauagcaugaaaaggcagccuaugagauaggagaaaacauuugcaaaccauacgucugauaaggcguuauuuaccaaaauaauugaaaucaggauguugaagagauacuugcauucccauggucugucgcccccaauauuucaauguagguuauuuuuguuuccuguaaguguuggccggucugagaaauaaagagaaagaguacaaagagaggaauuuuacagcugggccuccaggggugacaucauauugguagguccgugauguccaccuaagccgcgaaaccagcaagauuuuauuagggauuugaaaaggggagaggguguaugaacagggaguacgucacaaagaucacaugccucaaagggaaaaaggcagagcaaagauuacaugcuucugaggaaacaggaccagagcaaaaucagaaacuccugauaagggucuauguucagcagugcacguauugucuugauaaauaucuuuacagaaaacaggauuugagagcagagaaccggucugaccucaaauuuaccaggguugguguuucccaauccuaguaagccugaggguacugcaggagacuaggagaccagggcguaucucucucaguccuuuuuuuuuuuuuuuugagacagagucuggcucugucacccaggcugcggugcaguggcgcgaucucggcucacugcaagcucugccucccagguucacgccauucuccugccugggacuacuaacugggacuacaggugcgcaccaccacgcuaggcaaaguuuuuacauuucuaguagagacgggguuucaccauguuaaccaggauggucucgaucuccugaccucgugaucugcccgccacagccucccaaagugcugcgaucacaggcgugagccaccgcacccggccaagcuaucuccaccgcauaggacagacacucccagagcggccguuuauagaccuacccccaggaaugcaauucuuuuccuagggucuuaauauuauauuccuugcuaggaaaagaauuuaacgauaucucuccuacucgcacguccauuuauaggcucucugcaagaagaaaaauauggcuguauucugcccgaccgcgcaggcagucagaccuuaugguugucuucccuuguucccuaaaaucacuguuauuguguucauuuucaaggugcacugauuucauauuguucaaauaaacauuuugcaaucagauuguucaguuaaugcaaucaucacaggguccugaggugacguacauccucagcuuacaaagauaacaggauuaagagauuaaaguaggacaggcguaagaaauuauaagaguauuuuuagagaagugauaaauguccaugaaaucgucacaauuuauguuuccucugccguggcuccagccggucccuccauucggggucccugacucccugcaacaauggucauugccacauuaugauagccaggaugugggaacaaccuaaauguguccauaggauaaagcaaauauggcauauaugugcacuggaguauuaugcagccuuuaaaaagaagaaaguccugccauaugcugugauacagauaaagcuggaggacacuaugcuaagugaaauaaaccagucauggggcaaauacuguaugauuccacuuauaggaggcaucuaacauagucaaagucagaaacagaguagaguggugguugccagggaaugggaacuugauguucaaugguacaagguuuguuaugcaagggcgaaaagguuuucgagauguuuguuacagcauugugccuacaguuaacaauauuauauuguucuuuuaaaauuuuguugagaagguagaucucauuaaguguucuugccacaauuaaaaaaacuaaacaaaaagaaagggaaaaauaaguggauggacagaaaagaaauauaugaaggacuaaggaauauaugaaaaauguuuaccaaauaugaguuaaaauaaugugcucucaguucuugcuuauuucuuaauguuagcaccugguacuggcgaagaauaagaaacagcacucauauguacagcuccuugguaaauuacagcagcuguagcagagagcaaacaccuuccacccgggaauucuguuuuucagaauugguccuaggaaaguaauuuauuuacuuauugacugcuuuucagaauuguuuacaaugggggaaaauuggaaacaaccuauauaccuuacaggaauuaaguucguugacauuuuaaagacauuuuugaagccauuaaaauaacaauauaaaugcuuauuuaaucccauggaaagauaagugugaaauuuuuaaguuuaauaaguuuauuaagcuuauguuaaguuuaaaaacaaauuggagagcagucugauguguaaguaauuuaaauugaaaagaaaauucuggccgggugcgguggcucacgcuuguaaucccagcacuuugggaggccaaagcagguggaucacaaggucaggagauugagaccauccuggcuaacacggugaaacccugucucuacuaaaaauacaaaaaaaauuagucaggcgugguggcgggcgccuguagucccagcuacucaggaggcugaggcaggagaaucacuugaacccgagagguggagcuugcagugagccgagaucacgccacugcacuccagccuuggcgacagaccgagguuccgucucaaaaaaaaaauucuacgaugaacauaugagguuuuguuuuuuaaaaacaaacauuguacaugaauuaaaagcauuacugcuuuuaauuuaaacucuuauuuugcuuauugcaaaauaaaaggcaaugucacuguucuuugagagcuuaucaucuuacagguggguggaaguugauuguuuuucuaauugcuuuguguuaauuuuuugauaauuacaauuuaucuucguacugaggaagaggauaguguggaaaaauugggccuuaaguugaaguuucuacaacuggaauagagaauugaacuuacuacauuaaagacugugaggaguaaaaugaagaaaauguugcaauuaaugcuguguuagggaaaguaaggagauaaauauaaagauuaauauuccauauuaggcuaaggaagauugguuggauagagaugcuugaaucuccacacaagucacuugguuuaaauuuuaaucuucuuccucauucuuuaugaucauuaacaacaacaaacaauaacagauaaauugaaggcauuuuguagcaucuaagcaccccauacagauuaugcuagauucuugucuagaaucaugacaucauuguuuucuaaaucacugauuuaaaaaaacacauuucuaugcagaccaguggaauuucuguuuguuugaauauacugugauauuacaacauacugacuuaugaaacauucuguaucauccucuuuuguuauuuaagccuuaguauagacuuuacacaucguuuauuuuucuuugugucauuaugaaaacucggcucauuuuguaggcuuucuauaaaauuauucuaacacuuaaacuuuuuaauuuuuuucuggcugcaugauuuuugaaaaaaaaaauuaggaaaauacaaaaacauauaauaaagaaaaaauagaaauccucccucuucuaccucccagagcauuggugacauucuggcauguuugcuccaauauacuuaaucguuuuuguuuaauguugagauccuacauugcauaaaauuuuaaaucauguuuuuguuuuccacugacauccuaacacaggcucugcuucauaaagacucaucuuuuuuuuuuuuuugaggaguuuugcucuuauugcccaggcuggagugcaauggcacaaucucugcugauugcaaccuccaucucccagauucaagcgguucuccugccucagcuuccugaguagcugggauuacaggccccugucaccaugcccagcuaauuuuuuguguuuuuaguagagacgggguuucaccauguuggccaggcuggucuugaacuucugaccucaggugaucccaccugccuuggccucccaaagugcugagauuacaggcauguaaucucaccaccgcgcccggcccauaaagacucauagcuaacuuuuacaacuacaaacuguuguacuuuaggcacuaaaauuuccuuauuuuuuccucuacuguccuuggugaugccuaucuuuuccucuuaaauuaagacuuuuaaaaauaacaaagaugcuuuuuuuagguacuucucacauucguucaauuucagaaaauauggaguuccuaacugguaacagaugaucaaauaaucaaagaauuuuuuggaaccaauuuuuuaucuuggcuccccccagaggcauauauaguauaaaaauaguugugaccugaaaguaauugcuuauccaguuauuuaaaugagcaaacguaaaguguguaagagagugcuuggagcaguagauuguaagcgauggccauuuguuuauggacugccaaggcagcucccuugcuuuggugcacuugugcugcacggccaccaggaggcagacuauguuugggaaagaacugaauuuaguuuauuccugcagcuucuugcucugcuguuaagagauaucauuaacaauguuuauuuucaauaugugugguuauagcuuaauguaauucaaguaaaaauguuaaugaaucugauuaaucgaugauuagaugguaauuucuucuuuuagggagucuaaagaacuucccuuuuaacaaggauaauuuaaggcugggcgugguggcucaccccuguaaucccagcacuugggaggccgagguguguggaucaccugaggucaggaguucgagacgagccuggccaacauggugaaaacucaucucuacuaaaaauacaaaaauuagccaggcaugguggcgggcaccuguaaucccaucuacggaggcugaggcaggagaaucacuugaacccgggaggcagagauugcagugagcagagacugcgccauuacacuccagccugggcaacaagagugaaacuccaucucaaaaaacaaacaaaaacaaacaaaaaaggauaauuuagaauuugcuguuacugaagaaacaacaaacacaaccaaaagaaagaaaaaccaccuccuacuauauggagugguggcaugucuguuuuuaaucauggcaaaauuugacucuguucuucuguuuguuuuuaaugcugauugguuucuugguuuuuacaagguuuugggagguagaggaaaagguucugguauauuuuuaguauguagaaucuggaaggaaaagguguucagguuuuuuaauaauaaacugggaugaaguaaaaggcaacaccuagaagcagcuggccuugauuuuaauuccuugaucauuuagcuucaguugcuguggugcaauguauguagcagguuuuucgucaguguaugaacuagguguaucuuucucacaggaacccuggacagguuauugggucugucucucuugcugacaaccucuaaaauggcaaguugggggcuugagugaagagggagggggcuugagggaagagaacuuauuuaaauuuucucuuccucccucucucuucccugcuucauacccuacucuauagaauuucuaaaagaacugcuuccugcuaguuuuaauagcacuuaauaguguuauuuaugguaacaauucugcauuuauuucugagucuuauuuucuaggaaaucuuggaaacaggcauaggacauuuuuaaaacauuguuuuguuuauaacauuuuuaaaaauguuaagagcucaggcuauucgugguuuaauggaauuagcuuaagugggcauauuguuguuguuaauucuuauaaccauaucuuuguuuuucaaguucuuuugguuuugcuaucauguuuuaacauacuuuuacaagccacucuacugaaauaaaaauuaguagauaacuggcaaaagauauucauaacugugcccuccucacacuccuagucuugaaagaccacuauaagagaccacaugauguucuauaaaugcaauuacucaugcaauaaauguagucuuuagaauaugccuaucugauggacuauucuucuggaacucugauauuacaucugauagagaaaccguauuaaucuuuuacuguugauuauuugugagguccucagcaugugggaauuaaaguugaacuuuaaccuuuugacaaucugucauuaauauauuagaauagaaauuuucuuaaauauuguaguugagaacauuuauugccugaagucuuuaaaaaaaaaacuuuuccaaaauaccagguuuaaauguaguuuacauguaaaauaucuagagaaaaaaugcucauguuaucauugugaauauaaggagugaaaaauguuaaaaucaggacacaguuuacuuucaggaaauccuaauuuuuuucuaauuaugaaagaaacauuaggcacuugaaguaguuaauuuccccuagcgaucuuucaagugguuacaggaucugugacauuauugguuguucuguaaagcuccugagaccacccacuuucuccuccccuuuaccaucucggaugaaaaccauaacaacuccacaagcaugcacagugugaugugguucagaggcagcuucuagaccugcaggagggagauuguauucagaggaagagcaucauuuuggcaacaucugaaagugaaaacggaagccagaaacacuuggccagcccugggggauuuuuuucuucuaugccucucugguggaaugacauuugcuguguaggcaucuuuccucugacuguauuucuuggccuugaagaguacugaguuuaaaaagacaguaugugacaguccauggaaauugccucuucugugaaaucucgccaccugcuccgaagacauguuguugucucccaaauucuccuuauccaccauucacauacgacugacggccaaaggauugcuucgaaaccuucgacuuccuucaggguuuaggagaagcacuguuguuuuccacacaggucugucucgcauagaucucuguuuaguguugcacgggggaugucuucauuaauuugcagauguuuaucagagguuuuuccaaggagacagauaauuggaggaaaaaagcucucucuaaugagagaugaggcuuaauuuaaaaauuguuuucuguugcuucagcacaagugcauaguacuuuuacuuuuggcagcagauuguguuguuuguguugauggaaggcagaauuguugccuugguguucccuagcucuuuucuccaucaccagccaaaugugugaaaaucagcaccuguuaaauuauauuuuaguuccaguguuugggaaauaggacacagguaaauuuagaagaauauuuccuguucgccuguguagaugagaagguucccaucguuuuucauuggauaguuucucagucagauuugacaguuaauuuuaauaugcuaaaagauuucuguauacuaaacacuucugacagaaaacauccuaaugguuauggggaaguaguaagugaaucacaaaucuaguuuuccaaucuucauaauaaaagugugugcagucucaaaauacuuccccugagguuuauguuuguaucugcuuauuauuuucggugccuaagaugaaaauaaauuuaguauauauuuuaggcacguggugaccugucugcucacuuuuagggcauuggguuggccuauguugcuacuuuuguccuagaugauuuuacagcuacaguaaauuaaaucaguuuuauucuguaaaauauguuagcugggguguuuuuauauuuguuuugggcugaauagcguuaggugucacaggaauguuugaugaggauguaaauagauuuuuguuucugcuucaugugcacgugaccccucguguuucuuauuuuccacguggcucaucucugucccuggugauuuguuuucagcugacuauuuuuaguuuucccagaggcaucucccuucucugugggagaauucucauuuuuuccagcaccucucucucguguuucauaacuccccuugaccugucauuugauuuugccagccucucccuuucagucugagcugacgguaaauggggggaggcagcgaggaggaggucagcaguggcccuccucucccagcucagggccgcugcagcccuuccaacugaacaaauuaauaggggggaaaaauaacaaagggugcccuauauuugcaauaauuugucugaucuaaaguagcuccaaauagcuuuuaauuuuaaagaguucuuuuaaaaauacuguaauccacgcuccaaguuaaaaaucaaacaguauggaagguugugcaguccuaggcaagccucucucuuacccagagucccugucugcucuccguggagacagccgcucucagcugcuugcauaguguucuugcacguuuccagucacauguaaaucuaugcaggucuuuuuuauucuuuuuuguuauacagaaauaaaagcguacuauauauucuauaccuuuuuaaaguuaauguguuuuagauuugcaugugaucacauguuuaucuaccucauuaaaaaaaauaguucuguaacauuccauuauuggguaagucaugauuuacuuaaccagugcucuaguaguagacauucuaaguugucuguaguguuguugugaagcagauagcuuuccaagacagcguaagcaaacgacacaaggcuucuauuaccaggguuuaguugauagugauguauuggacacauuuuauuuucuaaacuuacguaaaacuauuuucuguuuauuugcagucauaauuuuuugagcuagaguucacauagaggugaucuaaucugucuuauaccaggaagucugaggcccagagaagugaauucgcuugcccagaggcacacaguaagugccagagauaggacuaaaaccugggacuucuauuuagaauuuuuggcguacauauuuuccagcugcaaauuuugcuguaauuuuguuagauccaaggaauagcagggauggaggaagcguuuuguguguuggaggcuuuuuaaaaucauguaaggaauauaauucugcuuacucccaauaucagucuuugaugggcuuauccauguuaugucauuuuaacguccgagaaaucguccgucaaguggguaauucaugccgucauggugacucuuaucugaauggacugucagcaguaacuuggguugguauccuuagugaaggaagugguguugguugccucagugcagugguguugaccuggaucccaagaggccuggauuguagccuugauucugcuggugaccaagugaauagcccugugcaccuaaccucacacggcuacaaaauaagggaaccacaagagaugacuuccagguuccccuuagccuccaaaucugugaauuucuggcugaagauuugaaaacccucaguguauuacucugcuuggaaauucaucuuaucuaaaugauuugucuccuuauuuuuuuaccuccuaaauucaguuaauacucaugaauuaucuguuucuuuucaugacaccaugugucuggucaucaaaccccaccuuugguuuuuguuguuuuuuuguugcuuuguuuuagauggagucucgcucuguugccuaggcuggagugcacuggugcugucugggcccacugcaaccuccgccucccagguucaagcaauucugcugccucagccucccgaguagcugggauuacaggugcccaccaccauacccggcuaauuucuuuguauuuuuaauagagaugggguuucaccauguuggccauacuggucuggaacuccugaccucaggcaauucgccugccucagccucccaaagugcugggauuacagacaugagcuaccacgucuggccaaaccucaccuuugaaucauuacuuguccugauuuauccacaaucaauugguugaaaacucuaagacuccaucauuugaaaucuugauuuguuuuuaccaccugccauuacccuaguccaggcauuaucauguugaagcauugaaacugcucuuccuggcuggugccacuggcucacaccuauaaucccaguacuuugggaggccaagggaagagaaucacuuaaggcuaggaguuugagaccagcccuggagaguuaaugagacccugucucuauuuaaaaaaccacacacaaaaaauuaauagguaaaaaguggccaaauaugaacacuuuuguauaauaagucaaaaguagccaaauaggaacaguuuuguauaauccagccuaagauguugacugggcuuucugaagagcuuaguauuuggucugugccuccagccuuucccuugcuucuagacugucuuucacauuacagauuaauucauucguuucauaaagaaguacccguuagaugaguacuguguaccaggcauaaugguaggugcugaaaguaugacugggacuaagucccacauggacccugccuucacacagcccacuguuuaacagaaggagacagagcaccaguuaauaaugcaggguguggacuugugcccaagcagcucucagcagguggagguaccuuuaauccagguccuccaguagaagugccuuuuaaguuggguccucaggaaauggagaauuuacuaagaaacaaaguguuuccgacagagaaaacagcauguaaaaaccuugaggggcuugaggaagggcuccuucaaggaaacaaaggaguuguaguauuucugagcauagaauguggugggacgggggcuggucauuguagagauccggccagaauaagcuuucucauugaucccacgcagagggcacugggcacucugauauauuauuacugggugguauccaucacuggcaaagcguguuguuggaucgagguuaucuuuccucuuuaaacaggggagaggaggaaaagagugaauuugucaggaacugugcgugauguugcaggacauuaggcacagaugaaaaucuaagaaguccagugaugacgucacugacauggagaagggucagcaauagucuuuuuaccaaaguauuaaacucggucuauuucggaauucuaccucaacauauuaguucuauuuuuauaaugaguuaguggagggaaaagacuuugcuaagaaauauucccugccacuuagcauucaguuuuucuaugaagcuggaaauucuuguauuaauugcuaugaagagugccauuugaaccucacagguuaauuuccuucuugacuccagugaaggcaauucaguacgcuaaagacagaauucuuucugcugagcuagugacauuaaaagugauuacugcagcgcaagggaggaacauguguacguacguaucgagggauggcagagguaguaucagaacaaaauauuuccauuuacuuuugccauuuuauuuuauuuugaacuuuuagguucagggguacauguaaagguuuguuauauagguaaacucaugucacagaguuuauuguacagauucuuguacaauaaauaguuuauuguacagaugauuucaucacccaaguauuaagcccagcacccaaguuauuguuuucugcuccucucccuccuccuacccugcacccucaauuagacccccaucuguuguuucccuucuuuguguucgugaagagaaccguuuuaaagaaguguucaguaacaggcaggcagaaugugaaugcguuuguuuaauuaggaugaaauucaucaaauuauguucucgcauuugguauucacuuuugacucuuuuuagauggaauuaacagcuucacuaagaagcaacuugucucaccugaagaaaagcagcuuugagguuguucgguggcucugccgugucaggaauccucaucucugcugucuucuuagccguguccucaugauuguugccucaugaucucacaguagcugcuccaggaaggaagaaaaagaaaugaggaagggguggugccaggucgcuuaagcuuccgucucauuggccgggucuuagucacaugacucgaccuggaagggaggcugggaaauagagcgugugacuucucuagucucugucccacagacagguauaaaauguuauaagagcucuauuggaauaucugccacagagaaggcagaacagguauuucucaagcggauguuggccgauuauaaaugaggggaguguauuauuuaacaaguuggaucuugcaacaggccuugcuauuuuuucucuauucuaugcguuuuggaggggcauugauuaccuguguguaaugguuccauuaaacuuucaaguuauuuugucguuuggacguaagucuuaacauuugauuuuugaucucuugaaugaauuuucaguuauaaaauacauugggaagaauguguucaacuuuaaauguggcuuuuguaugcuuaauauguuauuagcgcauuuauggauguguuauggauuaggagggcauuuauucauguacuguuaaggugacaguaaguaaacuucaauuucucuuguguuuuucguacuacaaaauguagacgucaaugaagccauauuagaaagcuuccauuaaaaaaaaacacauauauuagcauuugcgugugaaaagguaaaauucagggauuuguagaauguagaagaaaucaaaaggaccaaggugaagaagaacgagagauguagucuuucacugccccuuaguuaucuuacugugaauccagauucuuccuuucagccuccuugaaagcagucaugaaagauuuugcuggccucuugccacauagacaagcauuugcuaagaacuggugugaugaauggcaugaugcugaaaacguuuugucguggauugauuccaagcuucgguagcuguggcgguuuuagagcuguagcuuugccgugacaugaauaucugcccuuuuguaguuacagcuuucaauugaagaagacaauaaaguguugaauggcaaguuuugcucacaauagguaagauuuugauaaguuuuuaaaagugagauguugaaagggacaguauguccuaauuugacaaguuucagauaacuagaguuuuacuacacuaaauuauguuuuaauguaguaucuacuuuuacacaaaaauggaaaguaaguaauaaauuacgguuuagaguugcauucagaaugggaaggauagcaguguuuuucaucaagagacacuggaggaauauggcaagcuguauauaaguaaauacuuguuuuguuagaacaauuuauucugguuaauuaauagauaauuacccuauaaauuaauguaaugaugcuuuuuaugagcuuuaaagccucuuucagagcuaagaauaauauuuuauuaauaguauaugcauauuauuuucuuagaaacacaacaggugugauuuuagagguaucuaauauugaauaucauauuucuguauuuaucuuaggcaauacuuugggucauuuuaguacacgaggguccuuuuuauaaacaucagcaauuauguggcucuguggaaaauuaagaguaauagagcuuucuuuuggggugagagauuugccuuuuuucucccuggugaccugaguccuaggcacguuucuuccaaauugcuugucgacaguuuaguauuuugagaaugauguucucuuuuuauuuauuguuuguauuguaaauauuucuaauguuuaauguuuuaauuggcuauuuuaauuuucauuucuguuauaagauagucuguguuuuucuuuuccuuugggaagauacccagcagugggauugcugggugaaugguaguucuauuuuuaguucuuugaggaaucuccauacuguuuuccauagagauuguacuaauucacagucccaccaacaguguauaagcauugccuucucuccacaucuuugccaacaucugugguuuuuugacuuuuugguaauagccguucuggcugauaggaaaugguaucucaucgugguuuucauuugcauuucucugaugauuagugauguugagcauuuuuucguauguucuacuuuuuccauauguuggcugcuucugugucuucuuuugagaaacaucuguucauguccuuugcccauuuuuuauugggguuguauuuuuucuugcuaguugcuagcguuccuuguaaauucugaauauuagaucuuugucaaaugcauaguuugcaaauauuuucucccauucuauagguugucuguuuccucuguugacuguuucuuuuacugugcagaaccuuuuuaguuuaagucccauuugucuauuuuuguuuuugcugcauuugcuuuugagaucuuagucaugaauuccuugcgucggccaauguugugaagaguuuuuucuaguucccuccccccacccaggaauuuuuauuuuuucaggucuuacguuuaagucuuaaaucugucuuaauuuuugcauaugauaagagauaggucuccaguuucucuguuccaauuuucccagcaccauuuauugaauaggguguccuuuccccauuguauguauuuuugcugacuuugucaaagaucaauuagcuguaagcauguggcuuuauuucuggguucucuguucucuuccacugaucuaugugucuauuuuuagaccagugccaugcuuuuuugguugcuauaggagagaggcaaugccuucuuaaaaguacuucugaauguggugaauuuauauuaacucuucuuugaguuaggaguccauuuuagguacauaagaguaugagaaauuugguuuuuuccugccagcuauauggaaaauaguuuagggcaaguuuggacuguugcuucaggaaaaauuuuauaagcguaauuaacccaaacaggaauuuuuuauaugaauaugcuuucuauucucgaauaugcuuucuauucucuaaucugcuuuuaaugugaagaaaagaaguagaacccuuuuugauauaauaugagcuauugcaacgaauucuaccaauauaguaaugaaaaguuuaaauggugaggcauccuaaauccuccucccucccccuacaaauaauugggcuuggcuugggguuuuuuguuuguuuguuuguuuguuuuugagaacggagucuugcucugucacccaggcuggagugcaguggcgugaucucggcucacuggaacuuccaccucccggauucaagugauucuccugccucagccucccgaguagcugggaguacaggcaggugccaccacacccagcuaacuuuuuguauuuuuagucgagaugggguuucacuguguuagccagaauggucucaaucacgugacuuugugaucugcccgccuuggccucccaaaauguugggauuacaggugugagccaccgcacccggccuggcuuggguaauucuaaaugucuaaacacugugcuuugcugagcuuaaaauuuuccauuuucaguaaaugccaugucuaccuagaaauagaaaaauauuauauguaaauagaaaaauauaugucuccuaaauuauuacuguuaacucuuuuagaguaaacagcuaaugaacacuagaaaacuuuauacaaacauaaacuaauaauugacaugaaugguaacuuuaaaaaacuguauguaagauugcauaggcaggauaagcaccugccaccagaugcuggggaaacugacugaaagaacuucugugucagugucccugugagggcuuuuagauguguacgauuagauuaaggcagaaaaaagggaauuuucugucuguccaugccgcuagcagagagagaccucucacuagcuucugaguucauaaccuauguuuugucaacccacaaacaucgguuuuuaaugcaauauguuguagaaaggacuuaccauccagucagugacugucaccuuuuuacagauagguugagauuuggaguugaagagcugagcacuagggaaacaugagucagcagagaucuuuggugucuuugugccucucugagcaauaccacccucuuaugugauacuucuccuguccccgcaaagcaccagggcaggugcacacccaccacagcagugcccucaugguagauuuuaauaaauauauuucaugagugagugaguaggucagugaguauacacaaaaguggacaacguucguuuccaaauucuguguuuaguuuguguuucacggaacccaaggcaaacucccucaguaggucuggucucuaacuugauuuuaauaauuggaaaagccagcagauugaggaaauguguggcuucuucagccuagaaugaauguguccucagcugcuaguaugugguuacgguuaguccaugucuuaaugguuagguuuuucucucaaaauuguuuuuggucuugggauuuggaggucuauuugccuaagugauuugagccugagaaaugggcaucuuccucauuaaccaacuacuuucuuuaagaagaugauacaugacuucauugcacuaguuuuaaaucuuauuaaauugagguuucugaauagaaagaacaaagauagccaacagggucauccagcugcuuuccaaaugagcaaaugucuuugguucuggccuucguuuuccugauggaggcugccauuucauuagaaugagucccaguaaggcuggaucacagcugauggugguaauuaucuuguugagauaaaucugaaucgauauagaaguugacguuuaauuuuaagguuucugauuaaauuggcccuuuaaaaucagaacauguucuguuaauagguacaguaaacaaaauaauuuauacuucuguauaaaaccuuuguuaucaaaacaguaacaugcuaauaagcaaggguaagggcaaaguuuggcugauaauaugcuaauuucacguuaguaaugaauccugcaggauuuaagggaaccccuggcuuuucaguacugugaaguacguauugaugagccuugggguuuugagcgucauuggagauuuuugcaucaucucugaucuucagcugagccaggagugcugagagugggaagcauguggaaacugggucaucggcugccaugcggucacacuucauccuuagggagcacaguauauggagcggaagauggugacugcacagcacgaguuuccagcgccacggagagggcagucuguuggcucauuugcucucauuuuaaaauuugaagacacguacucuuagacgaauacaucaauguguucuuuccuccuuaaucauaaagcuauccugaguaaucacuuacaaacccugcguaauguuuagauuccuguguaguuuccccaaggaaaaauucugcauagacuauuuccuucauagcuaaguauuauauaaaaaauguauguccucgaauuucacuuuaacugucuguuaaaagugauuuuauuuacuucuuauauuuaacuuuugaauagguaauauauuuaccccaugguuaaaaaguauaaaaaaugcuucaggauacuuuuuagcugucugauuccuauuaccuucccuucaaaaguaaacauuguuaguacaauuacauguauucugugauauuuuuguuacggauuuauaagcaaaaagcaagaaucuugaagaauauuuucuccaaaauauuaauauaaaagacucaccucucagauuuuguaaauaauuauaaaccaacaguuuuaaagcucugaaauuguguuaaaaauagcguugauuagcauagaaauucuagaaagagaggcaaauguuacucaggacucaggaaaugauaaaggaguuaucaauaaaugaauuuuuaaguaaguuucgguaggacauauacaaaugauaucaggagaaugaacugugucuauauuuguuacaguaaauucuagauagugaaagaauuugaacauuuuuguuuauaaaguuauauaacacauagauguuuauauguagguuuguuaaaaugaguuaucagauaaugggcuuauauguauuauagcaagauauuauuacauuuguugcauaaauauuuauuuuuauguaugucauauauuacaucaccaccuaauccgcuuuccaaaaugugugggaacagaagaggcuuagcaucagaggccuggguucugacuuugaaucuggauucccauagaaguugucuacauccagggaagacauucacaccugugagccuucucuucccuaucugggguuauugggaggaugaaaagaaagggaaagugagagcacacugugaugagcgaaacacuguggaauuguuauguguuaugugacaauuucuaaaaacauuuaggaaaugacaugaaagaaugcuaaucucauggucaaauauuuagauuauuuuucauuaguauguaacuaauaauuuguucuuccuucagggcuguaauauuacgauauuaacuuggcuauuuucuacaucuaugcaagugacaauuauucauaagcuacuacuaauaauugcuaauaauaaagaguaauggauaaauacuuccucucaucaaguauuacagagacacagugggacaauggauauuuuagugauuuuagaacugagaauuaucaaguauuaauacaaauaugacuuauuuaaccauguaaugcagccauagaaaauaagagccuuuuuuucccuguuuuuaacuuaguuuauucaauauauuuagccauuuguucuuagaaagugaguacugauguuucuuuaagcaaucacuguaguagcuugccuuuuccugaaaaauuagagacaguaauuacuaaauuucuuuaaaaguuguuucagauuugcuaccacagaacguggaugcuguaaugaaagacuguuagaauaaggaaacuuuuuuuuuuuuuuaguuucuugugucuuuuuuccagauuuacauuuguuuggauuacuuggcuuguuuauuucaagaaccuaagcaauugauguccuguuuuuccaauucuguuugauauucaaaaugacacauuuggaaugguuccaagacugaacaguuuuuuauuuaaaacagaguaauacccagggcaccauugcacaggaagggaauaaucacuuagcguggcauuuuggguggauuuggaguguuagcaugugcuuuaaaaaaaaacuguguaagccguuauuacuacuugggaaaaaagaccaacaaagcuuguguucgauagaaaauggaauaguauagucaacaguauaguacuccuaacagugaacuuaaagaggcaaaaucugaguauauuuucgauguauguuaugauuuauuagagauuaggaaaugacucaucugcgguauaaaucuguguaauggcuaggccaucaucagggaaaagguaaaagauuuguagaaaauguaugggaggagagaaaggcauuuaauuuaaaguccagugauuuguguguuccuuucagcauaugagaucagaaaagucaggcuucucuucagucaagguuucucuaccaauuuaacuggaaaaugagaaacgaggagaacaacauuuugcacccaguuuuuguguuucuggguugccaaauccauuugugucauguuccuaauucucuguuccccauaaaucuuuuaaagucauaaaugaagccacggucccuguucaugaauuccaaccgucuagaucuccgauucauuccaguucucauccauaugcauuccuuacagcaacauaacuuaaauggauuucuguggcuuaucugguuguuuuugaauccuugugguggugauuuuaaaaauuaaccucaccuaucuuuguaccuauguuaauucguuuugcaguugaaaagagcaggcaaaagaauccucgaagcuuauguauccagccacagacagcucccgaugcgcugcccccugagaaaacacuugaauugacgcaauauaaaacaaaaugugaaaaccaaaguggauuuauccugcagcucaagcagcuucuugccugugguaauaccaaguuugaggcauugacaguugugauucagcaccugcugucugagguaaggaggugcauccuagaaagagccuuucuacuugaggucgggggagcacggggaggacuugcucacacgcuggccuugggaauaucuagguaaaugaugggaaagaucaggugucauucaucccauuacauuuuugucacuucaccagauacuugagucggucucuagcaauuugggauggaaacauuuucucacuuccuuuuuuuccccuagagucuguugguuagaauggcaacagcaaaaaacauaauugccucuuacgccgguguaugccucuagaccuaaacuagcauuagcauuuuuuucacuuaauuuguguguuugucuguguguagcuuuucauaucacacuuaguuuaaugcuuugaaaaaugacguuaguuauauuuauggauuaaagagcacuuuugaguuaacucccugaaucauaucuggggauucuuucugaaaguucuguuuauuccuaaaacaaucucuguggugcaacaaaagcaaagcagauuugccguguuguuacuuuucccuaauauucuucagggauguuauuucaggaacuggcuaaaauucauugagaaaaccaaguuuauaucaacauguuacugacauagcaauaaaagcuguaauuaucucagggggcaacugauaagaauacaacuugagcucuucagacauuuuuuaaaucacaguuuuaaagauggcuauacaugauaaugcaaaggggaaaaaaaaagacuggcucaguacuguggcucaugccuggaaucccagcauuuugggaagacgaggagggaggaucgcuuguggucaggaguucaagaccagccugagcaacauagggaaaaaauaaaaauuaaaagcaaaaagaaaacuguucaguuugguuguucuguaguuuuguucagaucaacaaaccuguccugguuucauacagaggccccuguaauauggcugccuuuuuagggaguggggagagagagaaguggaugagacuuggucugugccuuggagaaacuaccagacuaguagacaguuucaaugaauucucuuuuuuuuugagacagacucucacucugucgcccaggcuggagugcaguggcgccaucucagcucacuacaagcucuaucucccggguucaugccauucuccugccucagccucccgaguagcugggacugcaggcacccgccaccacgcccggcuaguuuuuuguauuuuuaguagagacgggguuucacuguguuaggcaggauggucucgaucuccugacccugugaucugucugccucggccucccaaaguccugggauuacaggcaugcgccacugcgcccagccuuaaugauuucuugaugaguauuuuacagcuuucuccagauuuuuuuguuuuuguuuuuguuuuuguuuuuuuugaggggaaguuggagacuacuuaggguuuuaguaacgguaauaguauaugguauuuuuguuucucuuucauuuguaagaaaggaaucaagaguguguuuauauaaccaaguaagcuaacuagaaacuguauacuaucaaauguggggaacaauuaguuuuuauguuuagaaauaaaccaauuauuuuauuuuauuauaucuagccuaauagcccccauccucaacuguuuucucuccuuucauccuccucaugacgucagucaaguccugugaacucucauuucacagugcuuuuccccuuccuaugucuuugcuguccccauucaugccauccuugcucagacccuggauagcuuccacuagaucaugauagcaacuuuuuuuuuuuuuuuuuuuuuugggauggagucuugcucugucacucagacugguaugcaauggcgugaucugggcucacugcaaccuccaccucccggguucaagugauucuccuuccucagccucccgaauagcugggauuacaggcacccgccaccaugcccgacuaguuuuuguaauuuucuaguagagacaggguuucaccaugugggccaggcuggucuugaacuccugaccucaggugauccgcucaccucggccucccaaagugcugcaauuacaggcgugagccacugcgcccaaccugugauagcaccuuuuuaaccaaucauuaggcuuguacuguuucucaccuauaauccaucccaagcacugcugacagcguccucuuaccaaagcaucccacgcugcugauuaaaucuuccagugguucucccuuaucuacagcugauguguccagugugguagccacuagccauaugagacugagcauucgaaauguaaauccguugaauugagaugugugguaaguguacaauacacuuggauuccaaaaacuuagaaugaaaacaaaggauguaaaauaucucauuaacaacuuuuauauugaauauauugaaauauuauuuuauauauauauuuggguuaaauaaaauacguuauuaaaauuagcuucaucuuuuucaacuuuucucagcguggcuacuaggaaauuuauaauuacguaacucauguuauuuuguuuuggggagucugguuuucaacugguacuauaaggcucuuuaucauuuggcaacaacugccccuuuuaauguuauuaucaugcccagaugcuguagccguacauaaagagauggaggagaagcaagagggauuuauugaauacuagguuugagcaaaaguaauugcgguuuugccaucaugccaaaagcuacaguuacuuuugcaccagccuaauauuuacuaagugccagauauucuuacuuaccuuauuuaaauccucaccaaagacacgaguuggaauuuacaaauaugaaaauugaggcauagaguuagguaauuugccugcuaucagacagcuagcaagaggagaaccaggacguaaaccuaggucuaggaagcuaucaacuaaaaauguccuguaaacuuccuguacgucauccauuguucacguaucauuacuggguugcuguccuugcccacaauaccuacauguucaggucgguuuuacagcagcaucacaucaccacuugcauuuaauuuacauagauucaguacacaaacaacugaaggaagaaaaaugcaggccgggcgcuguggcucacaccuguaaucccagcacuuggggaggccaaggcggguggaucaccugaggucagaaguucgagaccagccugaccaauaugguaaaaccccaucuccccuaaaacuacaaaaauuagccaugugugguggcaugugccuguagucccagcuacucgggaggcuaagguagaagaaucacuuuacuuugagagguggagguggcagugagccaagaucgcaccacuacacuccauccugggcaacagagcgagauuccaacuuaaaaaaaaaagaaaaaaagcaaauuaaaugaagaacacaaguccaccuuguauuccccccagugaacgaaggcccgggagucaauuugagaugaaggucaggaguccacccuuccuucaugugucugcucaguccccgaacaccucuuguggcgugagcauucuauacucucugcuaucuuaguguuuaaagauacuuuucccucaugcaaccuggccucuaaacacaagccgaggccuuuaucaggugcucaguuauagagagaguugauccaacgcuagaggaaaaaaauucacuggguuggaucuacagagagaugcauuguccacaaacauggcaagcuccuagugaauuucccagacaauuguacugugugugaauuucaccuuauacuuaaauuuagguccugacagccaaggaauugugacugcacugaauacagcuccagaacccgcuuuuuuuuuuuuuuuuuuuuuuuuuuuuuuuugcgacaguggccuugcucugucacccagucuggagugcaguggcgcaaucucagcucacugcaaccuccgccaccuggguucaaccaguucuccugacucagccuccugaguagcugggauuacggaugcccaccaccauacccagauaauuuuuguauuuuuaguagagaugagguuucaccauguuggccaggcuggucuuaaaguccucaccucaagugauccaccugccucggccuuccaaagugcugggauuacaggcaugauccaccacucccaguccagaacccacucaggaaugauuuccuggccuucuagaucuacguucuguucccgucuggauuccaggagcauauaugcuucucuuucauugucuguguuauauuagagauaccgguuuaaugcuuguuuuugcuuuuuaagacaggaaauuuacugaaggcaggaucugcaucuaguucuuucuuaugaaaccaccccagcagcuuuaauagucaacacaguauauaugugagugaacauaugaacggagaggauggaauuccagauguaggaugagcauaaagucuuauguaaauguucuuugcucucuuuauuuuauaaucagcaaauauuuacugauuguguaauguauacugagcacuauuauaaaacaguuggaggcuaggcaugguggcucacaccuguaaucccagcacuuugggaggcugaggcggguggaucgcuugagguccagaguuugagaccagucuggccaacauggcgaaacccugucucuaccaaaaaauacaaaaauuagccaggcaugguggcaugugccuguagucccagcuacucaagagacugaggcauacgaaucgcuugaacccaauagguggagguugcagugagccaagaucgcaccaccgcacuccagccugggugacagugagacccugucucaaaaaauaaauaaauaaauaaauaaauaaauaaaauaaaaauaguuggagaaaaaaaaucauggguaaaguuaaacaauuuuaaaaacucccuuaaccuuuuaguucccauucccauuacagaaguauauauacuguguuuauacacacacacacacacacacacgcgcgcgcacacaugcauauguauauaaaauagauacagauacacauuguauacauauacauuauguauguuuuuuauauacaugauauaccuauacauuguaugucuauguauuuuuauauauguauaauauauagguauuuguguguguguguguauauauauuuuuuguuauugcuaaccuuuucuaaauggcuuuagagccuucgauuaugggugaaaaugguuaagagaaucuugcaacuaccaugcuuuuguugcaagucuacuuaguaacuauaaguuucccacuguaguggcagacauauuucauuacauaucagacauucuuauaucucaugaaucugagaacuaaugucacacucuguuucgcagaagacacacuaaaguuauuuuaguuuuuuucuaauucuugguuuauccuugcuuaguuagacgguauucugcacagacagccaaagugaacaacaguauugaugguaguaauuaagcuucuuccuaaaagggucuauuggguggcuuucuagguaaacuugaacagggcugaggucacccuccccaaaccucuaauucuucaaaaugccuccacaucuuuuuuuuuuuuuuuugcaaguggaauuuaaccuaaaguagcaccugaacaaaggugaauuuugaauggcacuagcaguaaaguugacuuggaacaaaaaaacauagaugcauugagcaaauucacugugugggugauggggaggaggucagaugcagcacacgucugagccaucugauguggcuauucucugcaagaugcucuaugcuguugaugcuacucaguggcuagcaaaaaugcaggcacaccgaugggaccacagccagagacuaagugccugugucccagggacuccuaauucaauuauggugaauccauuuuuuuuuucuugagcauuucauauauuuaaugccugagcauaaaggcaucuuuauauccagauuuccaccuuucucuuuuuucacauuguguguaauucugcauguuacaauacaaagagaauugaaucaaccuguuaucuagacgguuaagaguuuaucaucuaagagagaaacacugaucuaggagcagcugaguaaaaagaaacaguaaaucaguaucuaaaggacauaaugcauuuuaucaucuacaaguaaaggguaaguacauguaaaggccaagcuaccagggagagucaggcagaaacuaacccuuaguaugugucuuuuacaguaugggcacuggggucagcauuucaucuauggaugguauuuaaagcccuugguuuuuuucauuacugcuucccauccgaugaggucaucugccuugauagaugaccaaaagaauugagccuggauguucuaguucuagguaggccccaugcuucuugaaggcagggaccaugucuuaaauuucuuuuauauuuucacagcaucugcuaugaaaaaugcuuaguuaauuaguuugaaguaauaaguuaccaaccaauuuagaaggguaaauggucuaugcauuuggaggaggggaauggugucacauuacaagggaagaaccaacugacuuuugcacaacccauuuagacaaagagugaaagaugaccucaagguuuuccuguuacuguuacugugccugacagagguuggaagaugucaguaguuucugaggcauuaaggacaggaacguggagugcaguggaguugaaguuuggggaaaugucgacaugcuuggugaaacucccuuucccaaaaccucccuuaauaagcaaaaauaucaccugguguauuuuugcaguagaacauaaugauuucacacaauuuuucuuugcaguuauacuaacuguaauuuuuaauuucuuucauccucccauuaguuuccauaaauuugaaaaaugauugaauuuucuugccaucucuuccuucuguuaguaacuugguuacuacugaaaagugaauuuuaagcaaguucaccaaaugaguuucaggauuguuugugggcauuuaguaaagcugucuuguuuuuccuguuacuugagugguaaagcuuccugguguuuacuugaaguagauuacuaaacaaaauucaggcuuaaauuugauauuacgagaaguauuuaugauacauauuuuuauguuuuucuuccauuauuaugcgggcugauuuuccucaggcuuuaauuucuacauuagaaaaccaauuacuuauuauuuuaagaaacucugacucacuggugauuucagaacaacuuaaugccauauuuuuaaaaaccaagcauuuagaauaccauugaagccagaaagguacucagugaaaagugggucuuaaaucccagucccugcugaccacguuucagugcuggcguuuagacuugacuuccguagcucuuacugagaggugagaacaaaguaaaaguuaaaaauauaugggaucuccaacucucagaucagcacuucagacuuauuuugaaacaccucucauuucauaaugucauuuaaauuuguaaacgacagcaugccccuuuccuugcucuucaccuaguucauaaccucauuuaguauaugggcuucgaagaacaaguuucccuuuucuauuaguaagugugaucaaauaaugaccacaauuagagaggggaagaaaaaggcucacaagucuaaaaauaacuccauuauccaugcagagggggucaguuuuuucuuuccuccguugcagcugauauuuaacuaaauggcaaucgaucagucuaaugccugccucucguuuuucauaaaugaaaggcuguggcuuuaaguaaucacaggcugccugugccaaaggcagaagcugcaguaucagcuucugugagugaggaauccgaggcacacgguaaccugcaggacaugaaguaagacgcccgagggccaauggcgcgccuccugcuagagcuuugaauguagacagacccgacugguggguggcgcggccaccuguaugcuucuugcacagugcgagggguggggggacuuggagacagaagcuggaaaaugggcugccccagcagcaaacugugccucuauucuccaugugcagcaacaaggguaauuaguauuuguuuauagugcuuuucuggaagaaugucaggacuacugcagaggcugucuggaauucagggaaaaugcuuugaaugacaagcaacucuugccugcaaaggccgggucucaugaucucugcaacgcugugaucaggauguggugggagcuccgucuugggugauccucgugagggcauuuuucagcgagcuuugaaauucuucauuuuuuuuuuaguuacucccuggugcuagggaaucuaccuuuuaaggaacuguauguaauuacuguauuuguguaaguauguguguaugugugauugccgggaguugcugguaacuugaacauuauucuucagcucaagguugauacuugcuucucugauacuaaaaacagccauccgguuuucuuugguuuguuucucuaacaucgauuuagaauuaucacugauccaaaauaucauaauccuuagaaaaugguauguagcugaaaaaaauuaauuuaauuuugucuuuaaaggauuaucuuucugcuauagcuuucuaacaaacuuuuugucuuucuuuuagaaggauuggcauuguaacgaaacuuuuuuaugugcaaauauaggacaaagugcauauaugugcuuauguuuagaacauuaaauauuuaucuuaaacugauuagauguuuauugcccuuggaggaggagaacgcauuacaucuuaaguacaguaugcauuagccgaaagguucuauggaucagcagugaagcacuggcucaaaguaaauauuucuaaaugggccauucacugcgucaaaccaaaguuucacugggaccugcaaaaauacagauuuuugaauuacgaauuuccuuaacagcuaagggacaacuguguuucuuuuaacaacacaaauuguuagccuaaaugauucauaucuuggcuucccaauacugggucucauuuuccuagugauaacaaauguguaccuuacugaaagggacccucuugaaagcaugaguaacuugauguguguuuuccgcagcgggaggaagcacugaaacaacacaaaacccuaucucaagaacuuguuaaccuccggggagagcuagguaagagcuuuuuguuguuguuguuaaauuuuaugggacaaggggaacacuggaaaaugugguuguccugucugcguuguggcuggaguugcaugcugggagcuguuggcacucccugucuaguaucugggcaaacacuuacuaucgacauuucuuuugaaucuuggcagcuugaccuucaguucacagaauuccuggcacugaucugacuaagccuagcagaacuucugaugagcaaaauauuucucuugcugaagagagggacagaguuauuuuuguaauugugugaauuccuguuaaauaauguugucauuuuuuuuucugaagcacuuuucauaugagaauagugaaaguuuccccucuugauaaacaguaaauccguuguacuuccaaggguugguuugugaguagugaguaugaaguugaaaggaugcuguccaugaaggcaacuuggcugaaaaaggcacguucuaugcuaaucuuacuauuuggaggggggcugaugguucaccaccuccccgcuccacagggagccccacgucucaacaccuaccacccagcccugcaguuuacaugucucaacacccaccacccagcccugcaguuuccaggucucaacacccaccacccagcccuccaguuuccaggcuacgcuguuauuuuaguuccauucucuccuggaagcccuuaggguucauggaacagacacgacacugccuuugcuuuguuuugcuuuucucuuuucuguuucuuuuucuuuuuuuuuugagacggaaucuugcucugucaccagacuggagugcaguggugcgaucucgacucacugcaaccuccgccucccggguucaagcaauucuccugccucagccuuccgaguagcugggacaacaggagcacaccaccacacccagcuaauuuuuguauuuuuaguagagaugggguuucgccauguuggccaggagggucuccaucucuugaccuuggccucccaaaguacugggauuauaggugugagccaccgcacccagccgacacucccuuuucuacgucaacucguaucuuggagugaucugaccgcuuugggguucuucucucugcccugggcuccucaaccuagagaaucaacuuccugcuucagcuucagccagaucuggagcugaccauucuagggcuuauuuccuugcccuuugcaguuuucuguguguguuacagucuccaccaaaauaugcccagguauguuguaugaauaaugcaagguaacauccagagaagcaaauuguguucacccaacucuaggagaaacugcccuuuuuucuuuuggacaagaccacacugccaaccugauuugcuggauuugaacacucuuaauucucccaccuucaccacagcagaaaucaaacggcagugaacguggggucaagacuuugucugggcugggugugguagcucacaccuguaaucccagcgcuuugggaggcugaggugggaggaucacuugaggccagcaguuugagaccagcuugagcaauauagcaagacccugacucuacaaaaaauaauuuaaaaaucagccaagcaugguggugugugccuguugucccagcuacucuggagugugaggugggaagauugcuugagcccaggaguucgagacugcagugagcugucauugugcugcugcccuccagucuggccaacagagcaagacucuguaaaagacuucucugcauucaucuucccuuuuccccuuccagugggaggugaggccaaaucccugacuaaccguccagauucuuaauaccuagccaagacaucaguccucacuuuauuuuaggcuguggaaaugaaggccucuuuauggaaaaguaauuuuaagacagauggaaacuucagaaucccaaagacuugagaguucuggugaaacaguucaaggaaaucccagcugagagacagcccagcucucagacuuugcaggcuuucugccauguuacuuaacuugacagcagcccuuaugauuaccuaaaugaccaacccaacuugcuuuuguccaugccuuaaauaacauaauuaacagaguuagaagaucaggaaagaggccuuuuuguguguguuucagaguucauuauaacccaguggaaguggaggugagccuaccuagagguucacauuucagccucucuccgaagacaaggcagcaaugagaauggaacacugugcccauucgcucugcuucaaugaaggaugcucuuuuuacauuuuaguggacagcacaauuaagcaaccgcaguuggggcccagggauucagcaccuccagugagucagguagccugacaggaaauagcuguaacagucugugcccacugucaccuuccuauccuugauaaggaagcuguccuggugcacugcuucuccugccucccgaguguugguacaguggguggccuauccagauccccagucacccagugcuggcuucuuagggaaugugucauugcugcuguugcagcaggcauacaucugaugguaaccguucuccguuuggagaaggguuuugguucuguaaguggagggaagcgaaaccuguaaacacuugugaugaagcgguccaggaagaacacucucaaggcugccagugggauuguuaguuucagcaugaaacuaacuuugacauugacauagcaaaguugggaacccaguuuuaaauuuugaggcaguaaagugguuaggcugauguugucacacuguccggggccacauuugugguaacugagugacuuaggacaagucacuuuguaucucuucugucccaauuucauccucgguaaaaauggcgaugcuaauugucugccccaagggugggugugaggauuacaugagguaaugcauuguaaagcaucuagcaccaaguguuaacugcuauuaaauaauagguauuaggauguaugcagcuugacagcuguguaguaauuaaccacacuggcuguuuugugagggcaucaucuaugcuacagaaaggaauaaucauuagacuaaauauuccuagaaaucccaaacgacaggcucuucaaacucaaguggaaaugagaccucaucagaguauucuccugauccaguagagugugguguguggagucaaagccuagguuuuuguccauccacuccuaguuggauguuaccuaacuucuuugaguaugguuuuuucgcuggugauaugaaaucaguauguauuuugcugcguuauuguggagcuugaauaaaauaguaaugcauauaaagcagugguguagugccuggcccaucacagcaacucaagaaaagagagcugccacuaucgccgucaucaaagcacccacuucuucccuccaaaauaauggggguggggcgaugggaguuggugucacucucccauuggguaauuuuucuucaccuucucaaugaaaguugagacaagguacccaaacuacuaagaacugcaaagaaaaaggacaguucauaaacucaggagcacugaaacccagguagagucugugcuuuccaccuuccgcaucuaacagccuccagcugucccagcauccacugacuuucccguuguucccucagucucacuguggcaguguccaaagcagccuguguguuuccacugucugagccacacucccuucauggaagcacugguucuuugcuucugcagaaacucuuaaaagugucccuuugguccagugauuuuuugauacucuacguugaugucuuuacugucucguguuuucuuguuaccuucagguauaaaguccauaauuguagggauucuuuucuguuuccuauggaaaaauaauauaauaugcuuucuguuuucuuggguacucgauaaauauuuuuggguauuuuaaguuuuaaaguuuuuuuuuuuuuuagaacaauguaugaaaauuaagauuuuuaagugaaaagaaaacagccggcagcuccacugcccugacauaacuuuauuugcauauucccuuuucuuaguuuauaugaauauauacaacuucauacuacgauuuuuuaaauuaagguguaauuuucauacagcggaaugcuaauuauuccaucaguuugacagacauauacuccuaaaaccuacauccuuaucaagcauagacuauuucugucaauccaguaaauucccucaugccauuucacaguggaacaccccucccccuagaagcaaacacugauuuaaccuuuauuaucaaagguuuugucugaacuagauucucauuuaaauggaaagauauaguaugcuguuuuuugucucuggcuuguuucauaauacuuuugagauuuguguauguuaagugucugcuccaaucuuuuuuuuuuaaagacagggucuugcucuguugccaggcuggagugcacuggcacuaucucggcucacugugaccucugccuuccggguucaagcaguucuccugccucagccucccgaauagcugggauuauaggugcauaccaccaugcugggcuaauuuuuguauuuuuaguagagacagggauucaccauauuggucaggcuggucucuaacacuugccucaagugauccgcccgucucggccucccaaagugcugggauuacagaugugagccauggcaccuggucagaugucugcugugaucuuuuucacuggauaggucaagcacuuuuccacauugccucauaguguucauuaugaucaccuuuaaugggcugggggaaagucugucaaguggcugucccauacguucacuuaccccuuaaauagugucauaguauauagcaaggguuucauugccagcuguuuucucauccauucccaugguuuccgcuacuaccuauacaacagugacacagauuuauuuuucuaguucucuccuucccaagcugcagaugcuucccagugaggggcugcccccaggugagccaguccaguauaaucagaccuuccugaugguccagccccuuccuuccugagcgccaugcagcgucuccucauucaccccuguuccucagcuuuggcagggucgauaugauucacuuaccacccaagcuaacaacugaaaucauacuccuguucccccauccuccacgugcaugucagucuguguccuaaaugccacuuggauccaucccugcucagcauucuggcugcugcuguuuuaagucccacaauuucucaccuggaagauacugcaacagcuacccaaugggucaccuugccuccaggccugcgcccccaacuccacuugcggccaggaucuguacuuagagucaggcugacaugugucucuacuggacauuuuguuuuuuuuguuuuuuagaaggaguuuucuacccugucacccaugcuggagugcaguggcaugaucuugggucacugcaaccuccaccuccuggauucaugugacuguccugccucagcgucccgaguagcugggaauacaggugcgcaccaccacggccggcuaauuuuuguauuuuaguagagacgagguuucaccauguuggccaggcuggucucgaacuccugaccucaggugauccaccugcugcggccucccaaaguguugggauuauaggcuugagccaccacuccuggccuguacuggacauuuuuaacaaacacaaaagacucuauuuuggccuugggggaaaaaauccagacauacuaagcacaccauuuaugauuugacugauugaaaucuuccaguccaaauucacgucuaggcacucuuuccccuuuguucagaccuccuuuccccucccaggccccggccauggguucauuugcaccucuuguccacaucuuuugcacgguauccucucugccuggagugcacucuccucuuuccacuccccucccgucgcggaccccucaugcuccuucucuuuuacucaguuuuuaagucuuagcuaaaauaucuucaauugaauuucacccaaaucuuucaaguaaguuaacugugccuucuagugugcuuuucaaagcacccuguacacauuuaagauuuuguucuuacagagauuuguuuauagaccucuucuugccaucuagaauuaggaacucuucaagggcaaggccaauagcuccuuaauuuuuguaguucucccaccuugugcuuggcacuuagcaggugcuuagacuucaaucaaugaaugauuuuauuaccaacagugguagcuagggaaagguaguuuucuucuuaaaauaugcuaauacucaguguuuuuuaugcacaaauguuuuucuauaaaccguuuaacauuucuaugacaaacacauauggacacaaagaggggaacagcagacacuggggccugccugaggguggagggcgggaggagggagaggagcagaaaaaauaacuaucggguacugggcuuaguaccggggugaugaaauauucuguacaacaagccccugugauucaaguugacccaaauaacaaaccugcacaugugccccugaaccuaaaauaaaaguuuaaagcagagucagaauaauuaaaaaaugaaauccacaucuugaaaagaaaagauaauuguccuuuaggaaugcauagucauaaaggagagcuguaacucucuuggauacauuuuauauuauguccgacaaucccaguuaaucagaucauuuugaaagugucagccuuggaaauagauuacaguuaaauggucuacaucugcagcagacauuuugccucuaggauaagauucuuuccagagucauguugaauaacagcuggugcaauagagggccaugauuaugaucuuuagaguucuuuuugcuuuucauuaauguuaauccuuggaaucagacuuuucaucuaaaucagggguguccaaucuuuuggcuuccccgggccacguuggaagaagaauugucuagugccacacauaaaaugcacuaacacuagcaaauagcugaugacgaaaagaaaaaaauucacacaucucauaauguucuaagaaaguuuacaaauuuguguugggccgcauucaaagcuguccugggccacgugcaggcugugaguuggacaagcuugaucuaaauuaaugaagauuauuuuguauuucaaaauuauuuuugagccaucacaauuaacagcuaacucucaucuuuuuauacauuaguccugauuauuucuauuuugugaaacaagauuuuaauccuuaauucacuaaaaaugcuugcccuuccuauaauaguguaaaaagaccaguugauuuuugugcaugaaaauuaugagcuagguauaacaacaucguguguuuggugccuacucaucccuaacaaacaauguucagcucucagucuacuucucugcauuguauuuauaaaaaauaaauuguggcucagagguuaaguaacuucccaagggaagcuggaaagcaaagagcuugcauaagaacccaagauggcuagaccaccaaucuucugguagucaccacagggaaaguuugaugaaaugauuuaaaagauuggaaaacuauuugaaauaaacgcucguuugcauugauagcuacuuuuggaauauuuuucuucuaaucaagaguuuaagaaauauuguuaaaauguaucuuacugaggaaaguaacuugcaaaaaacaguacauugccaaaagcaguauacacauugccuaaucaacacuuaacccagugucuaugaacuucacauugccucacgccauauggaauguguugauucauucacuguuccguuuuuaucuacaauuuugguuuaacaaggcuauguauuuaaaauaauuuuuaaacucuuuacagguaagucacuuuugaguuguaaaauuccagaagugacuuuucuugaaguaggcuuuaaugaaaaaucuauuaauauacugaaaaccaacuguacaccaaaacagggcuguuuaucucccugacuuguuugaagacugaguugauagccaccucagacuuagcucauucucuuccuauccacaucugcccucaauuuggacuuugguuggcuguauuuauaaguaaaaggccauguucuuucaccugcagauaugcaguuuuaccagugguaccuguguuugaaacccacugacuguuccuccuuguccuguuccuuguccuaacuccagucucucaacuugggauuuuccuaauuuaauaccuuauuguguagaauaguggcucccaaacuuuauuguguacgaaaauagaccugguugaaaugcagauccucaguucucaugcccauugcuucugacuugguuggcuggggaugaaguccaggaaucugcacuuuguuuuuuuuaaaccccaacgucuccuauacccaucauccuacuaaccccucuuugggcuuuaaggaauaguaauaggugcuucccaauuacagaaggagaggcagcacuucuaaaaagauguuguguugauggggaaggugaucccucuuccugaccucuggcccuaguguccucagguuaacaggagaccaguuuuucuuccuuauuagcaauaucugaguacagcuuuggcuaccugcaaagaaaaauaaagcaaaaccuuucccuuaauggaaauugaggaggaaucugcacuuuuaaugaucauccaggugguucucauguaggugccccaggacuacccuuugacacugcucuagcugccuagaauguuguuucuuuuauguaaaaaaauacauacauaucucaagcauaguaagaauaauaugaaguaacuccgagugaauugaguccauucuuauaaauaagcuuuuaaauuuuacacaugccaaggacuuuuagcagccuuuuugacccucgugcucuaaaaaugauccgucagugaggagaagaggcagaaugaauagucccugacuuaaaaucauccuuuuuuuuuuuuuuacauugaaacucuugauugaaacaggauuccuuuaaagucagccucacuuuuucucaggccugaaucuuagaacauauugucagauauucagcugugcucucgccuccaacccacuuuuauuccuaaauguguucguuuauacacggaguguuugcuguugugauuuaaaaaaaaaaaaaaaaaaaaaaaagcaucuguucugcagcaugcuggccagugaaugagcugaaaaacagcaaauggccuuugcaggcuucucuucaagggugggaggaggaacacuggcagggagaggcuagaaccuuaggggaggcccggcugguaccuaggcaccaagauggagauggaagacaggcuggcuggguggaauugucuucccaccugugagucacacuuugucagcacuacccaguauagggggggaaaggucauuuuuuuaccugccuuaucuuggaaucuuuucagcagugcuuccacaagagaauuaagcccuacuacccugaggcauccaugguacgugugaauuaacuuugucuucuacaucucaggcugggaaaaauagccagucagaucccgcuggguguucugugguuaggcucucaaagaggcuggaguucuagggccgggcauaguggcucaagccaguaauuccagcacuuugggaggcugagguggacagaucgcuugaugcccggaguuugagaccagccuugccaacauggugaaaccccauaucuacucaaaacacaacaacaacaaagaggcuggaguuguagauccagcuccguuauuuccauucuucuuugguaaaaugagaugucugauaauaccuauuuuauucguucagagcauuguuacauuaaaugaaacaaaugugagagcaccuuguaaaguaugaacugaguuuuaaaggugaaguggcauuuaugggaggauugauuugauugugcaggccuuuuguaaaaagcaaguuccuaauaauuuaugauuuauggaagacuuugaaaugagcucuuagugauuuguugauuuaaugcccaggaguaaucagaaaggcauuuggagauaauuuggaaauguagaaaaagaaccuggucuaccacuugucugcaaaauuucuuggucauuugacaaaguaucuuuagagaggcaaacccuggcacuaugugaguaggggauuauuccacaggcugggaagacuuucuacaaagcauaagaguaacucuguuucacuuuacuaucaccaaucuauacuguuggcagaacaggugguauuuguuccuaccuuccauaucaggacacggaggcccaggaaacuggacaugccuauuugugggauagucugggucccaccuuuuuuuucuucuuuaggccacugccuguccacaaagcaucaauuugauguuuaaaaaugacuucuugguuacuuguucagugauguuacuaccuccaguuucaaaccagaucagaccuuggcuuaagggggucaccuacauagucgcuugccauggacgugugucaggaucggauuuccucggauuucccuuaguagaauguuaugacaucaucacacuccuacgguagaauguaguguccccuccugcuucuggggguggggcacaagagaagugacaguucuguuuaccccgagaaguguaauggguauguacuguugaagaaagaagugaaggagcccagaacugagaggaggaggccgguuucccaggcggccaagagagagugaggggcccacugcaggcagagcuggaggcaggcugcucuucuccauccuagauggugcagagagggggauuucgggguggggugggggagagucgccacccacagcaggcuggccagagcgucugggaaaggaguaugugugcaguuugggaauggaaucaucucuuuuuccuguucgucucuucuuucuaugguauucucuuauguggcgcuaugaaaauuugccuggcacuuuucuuuuuuauauuuuaguucugauuuacauaaaaucuccuccaaauuaggaaaauucuauugcguauaaugucaagaacaauaguagcggaagggaaagacuugaagugaguguacacuccaccauaauagcuacgucuguguguucauaugcaucaaauuugaauacgaggccagcaaugcugcuuuuuaacuguuauauuucuguuauggaacccuaagccugucuuccaggagucuucaaacacacuggaaucaauggacucuugcaagccguaacaguuauacaauuuaucugcaaaguuacuguggucaggcacuggggugagugcuucaccugugcuauuucaucuucuagagaagggacuaauaauaucuccacuuuaaaaaugaagaaauguaggcuuaggccaggugcgguggcucaugccuguaaucccagcacuuugggaggccgaggcaggcagaucauuugaggucaggaguucgagaccagccuggccaacguagugaaacccugucuccacuaaaaauacaaaaauuagccggguaugguggugcaugccuguaaucccagcuacucagggggcugaggcaggagaaucgcuuaaaccugggaggccgagguugcagugagcugagauugugccacuacacuccagccugggugauagaggaagccucugucucaaaaaaaacaaaacaaaacaaaacaaaaaguaggcuuagaaaguuuaaguaauuugcucaagugauguagcagcugaguggugugacugagauuugaacccaaguaauuuuggcucuauccuauuaggacauuuauuuauguucuugagcauuaaaauauuuuuggucgucucauaaugaaccaugcuacucagauauaaaaacuaggaaagcacuguaucauuucaaaagaauauuaacaaugucgggccauggcuguguaaugcuuuucucuguaaacaguacauuuaucaaucaacaaagggaaaugagucucugugagauggaaauaauaaaagucugaccuuccccucugagaaaaagccaugaggacuaauuaaguaauggcuccacuccaguucugcagggcuaaguaaugaaggaccugggaggacuccagcucuguuuuccagagauuauguuugacuguggcacugggcauuuuccacauaucaucuugauaauuacuugaaaagcaaaacuuaaagcauuucacugauuacgauuuuuuuuucuugcugagauauccaugauuuaaacugucagggagggucacuggccuagaauucuucuugggugauucauugcagagugaaaauacugacuucuaaucucaauguggccuuacauuuuagagauguuuuuguacaugaguuugccuuccuuuccuucuucuccuuccuccccuucccucccuuccuccuuucuuccuuuuucuuuuuuuuuuuuucucuuuuuccuuaaauccugagaacuguauuuccucuuuuaagcuagauugcuggagauagcuuucaugguuuacaaacauguauacaaaaguugcccagcaguucuccuacagaugguggucuguugguguuccuaaucauauaugugcuuuuuuaaaaaauagacuaauggaaugauuaaaacaacagaggccaggcacaguggcucacaccuguaauuccagcacuuugggaugcugaggugggcggaucaugaggccagaaguucgagaccagucuuacccacauagugaaaccccaucucuacuaaaaaacaaaaaauuagccaagugugguggugugcaccuguagucccagcuacucgggaggcuguggcaagagaaucgcaugaacccgggagguggagguugcagugagccgagaucgugccacugcauucuagcccaggugacagugcgagacucuaucucaaaaaaaaaaaaaaaaaaaaaaaauagggacaaaaagacuacuuugacuuuguguuugucuaauaccuucuuucaaacauucgcauguccaugcuugcuuguugcaaauucgaaacaauuuuauguuugguuuuggcuuuguggggugucugauuaauugaaagugaguggaauucuggagaaugagcaagaagagacuaggcugaggauaggagugagagcacacacagguggcaccauaaaucucuccuaagcuguagucagugcacaggaaaguccauggccuaaaaucgggguuaugcacgccccccaccgccacacacacacguuuaugucacagcugccgaggagcacucugagaaccuuuaauacagcguuuacaugugcauccuuuaaaaaauacuucaugagucuuuaugccaaauaaauguuuccuucgcagcccaggccacuuccuucaaacgaaagccauuagugugagcgauuacugcagcccagcuguuccccagcagcacaccgggccaguaaacagagcaaaggucugugcacagcugcaggcugaugucacugucuggggcugggccugcugcuuuggacuauuacaauaacagcagugaaccuccuguucccccaucugacccauuuucucccuuucucuuucccguuucuucccauguguccucucuucaccucacuuaucaaaacgucagagcugccuuuuuuuuuuuuggugaauagagggaaacagcccugucccauggcuaauaggaaaggacuucuguguauccuauuugguuuuaaaggcugaugugccacaauuacauauucaaagcgacaguauuuuuaucauaaacagauguguuaaaaucagccaggguagucugcuauuaacgucagcuucgaagcucuucuagcccagggcuuggaggcagucucuuguuuauugcugagucccugaguucacuuagauguuucugucccagauaugagcuuccagauggguucagaucuuguuccugcuuuuuuauuuuuuaacuuuggaaauaccggaaauuuuaagagaagcaagugaaaagccugcgugaaacuagaauuucucugacuagaagcuauuugauaccuucaccaacggcuugcaaaguauguuucuguuguagguuuucauagaaaguucuaauacgagauucacacgaggagccuucagagucggaaaguuacuuggcagaagcuaaugcaguguuuacucguuugacuaacauuggacuucuugagucauuuuuucuucugugguuacuaguguaauagaaggaaaagugaaugugcagagaauguucuccagcagucaagaccaucacuaucuuucacuaaauucuuuuaaaggagaaaagaaacuuuuaauauucagucccaaaggcuugaguugcgugcgauggccccuguaaucuggccuccgucugucuuuuuggguucuaucuucucugcuuugugaguuucuuaaucaccaaggcucaccguucugucgcccaucauugcucaugcugggauaggauuuucauccuugaugccucaauuuuauuucuaucauauggcuuaauuugaaaaucuacugaccaaaucauaaccacagugauguacucauuaggauggcuguuacauauauuugaaaaaaucaaauagguucuggugagcauguggagaaauuggaacccuuguguguaguacugcugaugggaauguagaaugguucaaccacuauggaaaagaguaccauaguccuucaaauaauuaauaauagaauugccauaugagucagcaauuccuucuggguauauacaccaaagaauugaaagcagggacucgggcauguauuugucccccgguguucauagcagcauuauucacaguagccaaagguggaggcaacccaaguguccguggaugguaaguggauacacaaaugucaucuguacgugcaauggaauauuaucauuauuauuauuugacacggagucuugcucugucacccaggcuggagugcaguggcguuaucuuggcucacugcaaccugcacugcuuggguucaagcgauucuccugccucagccucccgaguagcugggacuacagacgugcgccaucaugccccgcuaauuuuuguauuuuuacuagagaugggguuucaccauguuggccaggcuggucucgaacuccugaacucaagcgaucugcuugccuuggccucccaaaaugcugggauuacaggcgugagccacugcacccggccaacaauggaauaauauugagccuucaaaaggaaggaaauugugacacaucccacagcuuggaugagccuugaggacauacgcuaaaugaaauaaacagucacaacaggacaaguacuauuugaguccagguauaugagguacugaauggucagauucauagagaaagaaaguaaaauggucgcugccagggccuuggggaaggggaggggauggguuguuacuguuuaauugguacgaaguuucagguuggggggaaacguucuggagaauggaugaugacaaagcuuacacaacgauguaaguguauucaaugccacugaaucauacaccuaaaaauaauuaaaaugguuaauuugguaucugcuucaucacaguuuuuuuguuuuuguuuuugagaugaagucuuucccugucgccaggcuggagugcgguagugcgaucuuggcucacuguaaccucugccucccggguucaagcgauucuccugccucacucagccugcugaguagcugggacuacaggcacacaccaccacgcccagcuaauuuuguauuuuuaguagagaugggguuucaccauguuggccaggauggucuggauauuuugaccucaugaucugcacgcuucggccuuccaaagugcugggauuacaggcgugagccacugugcccagcccucaucacaguuuuuauuuauuuauuuuuuaauuguuuuaaaaaucugaccaaaccuuugguccacccugacuggacguaaacuauccugagugccacucccugggccccaaggucuggccugguccugccacuucuccucugucuguugucucuuccaguagaggccccaucaugcgccuugccagccccagcacaagaaacagcuugguagaaaagaaggggcacgggcuuugggugcaggcagaaucagaauucagacugcucaccgaaacccauccucucacgcuugccagcucugugccccugggcagaugauuuagccucucuguggcgguuuccuuaucuauauguuuaggaggguccucugugaggguuaaacaagauaaagagccccauucugugccaggcaacgagaaauaguuuuuguuuuggggauuuuuuuuuaauguuaaaucuuugcccuucaauaaacauuuguagauugauuuaauuuuuaaggguucucuuuggcagacacuauuccugccauuauuucaauguggccuccuuuuccucugaaagaauacugacugggggcaagugacuuggguauuucuaccaccacauggcagguuccugagauaacaaguugacaccauuguaggaaaucuuccuaagaaccugccauuuucacguuccuuaggccaaauaauuauugaucuaaauuguccuuuucugugcccuaaaauaaucuucuuccuucaacuccugauauguuauuccuuuccaaagagagguaaggguuaauuuaacagauuugccagcaacccugucguauuaauccacgaguacucuggggauguggacagcauguguaucccugacaguuacaguaguacccugucugccuguauuuacacaucggugacagaagacugggaauguccaaagucaggcuuccuaaggaauucaagauuuucuaggauuuauuguaguguguguacauauaucuuugguuguguucugccauguauuauauuguuagucauucuauuuuugguaguuguagggaagagcuaagauguucugauuuucaauuauguguaucagauuacuuugcccuuuuaaaauauauuaacugggaggccgaggcaggcgcaucacgaggucaggaguuagagaacagccugaccaacaugguaaaaccaugugucuacuaaaauacaaaaauuagcuggucgugguggcaugugccguaaucccagcuacugaggaggcugaggcaggagaaucgcuugaaccugggaguuggagguugcagugagccaagauugugucauugcacuucagccugggcaauacagcaagacucugugugugugugugugugugugugugugugugugugucuauauauauaguguauauauguguauauauguauuauauauguauauguauaugcauguauauaugcauacauauauguacauauauacacauguacacauagauauauacauauaugcaugcauacauauguaugcauauauacgugcacauauguaccuauguauacauauauaaauuuuuuuaaccuuucauuuuauauugcuuuuuuuuuuuuuuuuuuugagauagggucuugcucuguugcccaacaguugcagccucaaucuccugagcucaagugauccucccaccucagccuccucaguagcagggacuacaggcccacaccaucaugccuggauaauuuuuuuuuuuuuuuuuuaauuuuaagagauggguuucccuauguuguccaggcuggucaugaacuccuaggugcaaaugauucuccugcaucagcuucuuuuuuuuuuugagacggagucucucucugucgcccaggcuggagugcaguggcgggaucucggcucacugcaagcuccgccucccggguucacgccauucuccugccucagccucccaaguagcugggacuacaggcgcccgucacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggucucagcuucuuaaaauacuugaauuauagcacaaaccaccgugccuggccuaugugggugcuuuuaagauguguuuuuuuuucccuaagauauuugugcucuggugauuugcguuuaauagaggcuaauauuuuauuuuuauuaguuuugaaauaacaaauuauaaucaacucaaauuaacuacaaguuuaagguccacuuguuucuuuuuuuuuuuuuuuuuuuuuuugagacagaaucucacucugucgcccaggcuggagugcaguggcgcaaucucggcucacuggaagcuccgccuccuggguucacgccauucuccugccucaacuucccgaguagcugggacuacaggcgcccaccaccacacccggcuaauuuuuuguauuuuuaguagagacaggguuucaccguggucucgaucuccugaccucaugauccaccugccucggccucccaaagugcugggauuacaggcgugagccaccgcgcccggccgguccacuuguuucuuaucccucgucuuuccugcucuugugugagcuucuaccacacuggcuggcugggagagggaggagucgcuuguccuaagaaaugucucugccuggccaaggcucuuuucuugaccacugcauugacuggucaccacaugagaggggaucuucucuuagaaaccugggucuucugaaguacuucucuuacugcuugggagucaguuuuuugaaugugggguggggggggguuuuguuuguuuguuuuugagauggagucucagucugucaccccggcuauagugcaguggcgugaucuuggcucacuacaaccuccgccucccggguucaagcaauucuccugccucacccucccgaguagcugggauuacaggcaccugcuaccaugcccggcuaauuuuuguauuuuuaagauagacaggguuuuaccauguugaccaggccggucuugaacuccugaccucaggugauucccccaccucagccucccaaagugcugggauuacaggugugagccacugcgcccugcccucguguuccuuuuuacaguucacuuccauacuguuauauuugaagacauggucacuagagacccaagacaucauggguguaugcuucaggugucaucacagcugugugugacuguaaugaauauaggacauuucacaaauaaaaugaccucuucccucuucuuucuccucuguuuucagucacugcuucaaccaccugugagaaauuagaaaaagccaggaaugaguuacaaacaguguaugaagcauucguccagcagcaccaggcugaaaaaacagaacgagagaaucggcuuaaagaguuuuacaccagggaguaugaaaagcuucgggacacuuacauugaagaagcagagaaguacaaaaugcaauugcaagagcaggucugugcuuuugcagccagagcuugucugaggccucugcugcuuacuugaauccugguugcucuucacaucuugaugagcuucucuuuuuuagucuaauagguauaaaaagcauguuguuguuguuuauuuaagacagagucccacucugucucccaggcuggaggcuggaguacaguggcuugaucuuggcucacugcagccucugccucccggguucaagugauucuccuuccucaaccuccugaguagcugggacuauaggcacccaucaccaugcccagcuaauuuuuguauuuuuaguagagacgggguuucaccauguuggccaggcuggucucaaacucccaaccucaggugauccgccugccuuggaaacaguaucuuuuuaauugaauaguuuucuuaugaccaaaggaauguauuauguuaagugaaagaagggaagaaaaggaggaggaaaagauaaaauugaaaaaacaacccuuucuuucuacccagaaauaaucccuuguaaacauccuggugguguguugccaaacuauuguuuugcauuucuuucuuuuuuuuuuuuuuaguggcaucuguuuaaauaucccauuuuuuuuuucacugaauaaaauaucaaaccuuuuuaauuuuguagcucccuuuuuaacucaguuuuucauuuaguaaauaucuacagagugccuacuccaggccaggcacaugcuagggccugaguggucaagugacaggcgcagagcauguggcccugucacugugaaacauauccucguuccuggucauuccuugugacugaugcagccauuuccaucugucacccuggagagccucugugucuguguuccugaggguagggaaggagacagaggagaguugagcggugaaucccaguugcguugcucuucaugcauucuuugugugugcacauguggggacagagucucgcgacauugcccaggcuggacuugaacugcugggcuccaagugauccuccaccucugccucccagagugcugagguuacaagugugaaccacugcccugaccuuuguauguguugaggagccuuuaaacuagagcccacgcuuaccugugaagcugugacgucuccuaaugugguugcuuugcguauucaacuuaggacauuugguuuuacuguuaaaccacgguuuuguuuguugcuuacaguuugacaacuuaaaugcugcgcaugaaaccucuaaguuggaaauugaagcuagccacucagagaaacuugaauugcuaaagaaggccuaugaagccucccuuucaggcaaggaugcuuuuuuuccucuuuaaacagaauaaaaucugaaggaaccacaugauguuuuaagauggaaaugauucauaacuuccugcuucagcgaaugcccuguggccuucaggcugggguguucuugguuccuuuuugcgugguuuauuguuaacagaugccuuuucccacuaaggaugcaaauaauaguuacaaaugccagccuuguguuaaauaggaugggcuuuggaagacuguaaaggccauuuuggcgguggugguugccagcuuaggucccugggaaguggcaaguacaaguuucuaucuuguaauccacaguaaaggauccaccccaagugcuccugcacagcaguguugcugugaaaugucgaugccacuuauugaauagaaaaauagucuuuucuauuuuucaucugucaucagugggaggguguaagccauugcuuucagaacagaaucggcagugucgcucacagucuuucuacuaaaccaguugcaucuuacagagcagcguggaugagugcuaagaaccggcugugugaccuucagcaaggacuuucucaccacaaaaauagaguugcccaaagucaggcagaggugauaauguguaaaagugacuggcuccaggcagacuuguagugaacauuguuuuucuuccuuccugcuagaaaugaguauaauuuuagacuuauguuuagguuaugaagagcaaauugaaaagagcacaggguuuccagaccaggagucuggaguggcauuuaugagagccugcccugaaauggcacucaguguuguccuaaggucgcauggccucugugggccauggugggcuucagugggccucagggcucucagucauaaaaugggaaugucuacccuaaccaccucucaaggccauuuugagaacagauggccaauuuacauaaaagcauacuauagauguaaaguaacgucauacggcuucaucaucaaccccuacaucuauaugcuuuaacuguuuuagaguacauugaucucauagaauguuauugccucaaaaauauccguuuauuuucccagaaauuaagaaaggccaugaaauagaaaagaaaucgcuugaagauuuacuuucugagaagcaggaaucgcuagaggugggugaaugucaauaucccaguaucccccacaaaaaaaaauaucauuuuugauuuuguuugguuuuaauguuucuguguacguaugcugaguuucugggguuuucuuguuaacuuaaguuccacauuucauuguguuuuagaagcaaaucaaugaucugaagagugaaaaugaugcuuuaaaugaaaaauugaaaucagaagaacaaaaaagaagagcaagagaaaaagcaaauuugguaaguugugugugcuccuuuaucaguauggaauuuuucuucucaguugccuuuuagagucauucaaguacucagcagccagagaaauaacacagguugggaauccuucucaugucuggcaaugugcuuucuaagguguguaaaacaacugcuuugcuuacuggcgucuuguuuuaccauccuaaaaucugacauacggaugaaguccaggauguuucugguggucuaagcuaaaaagaaggaaacuaccaauuaggauuagaguuuuaugugaagacuuuauuuaaaaaaaaaaucacuguauugagauaaaacaaacuacaaaguucacucuuucuuuuuuuuuuuuugagagggagucucacucugucacucaggcuggaguguaguggcgugaucucggcucacugcaacguccaccuccuggguucaagcgagucuccugccucacccucccgaguagcugggauuacaggcacgcaucaccauggccagcuaauuuuuguauuuuuaguagagaugggauuuuaccauguugcccaggaaaaguucacucuuuuaacauguaaaauucaguggcuuuuaguauauucauaaaguuguccauuggucaccaguaccucuuucuagaacauuuuuaucacccccaaaaggaacccuggacccauuagcagucacuccccauucccccaaauuccccagcaccaggcucucccccgucuacuuucuaucucuauggauuuacuuauucugaggaaugaauagaaaagguugauuguagaacaugugguccuuuuaagacuggcgucguuuacuuaguauaaaguuuccaagguucauccgugguguagccuauguuaguauuucauuucuuuuuauggaugaauaauauuucgccguauggauaaaugucaauucugaaaaguacaaaucucuuggaagcugaaauuucuuguggcacauuuguccuuuuuccccagccuuaccccaaccuuugucuuuuugaaaaaaauuuguuuccuugcugcuucugccuuuaguaccacuguuuucauuucauguuuauacucugagacugcagaagcaaagcuuuucuccacuucaaaucucuggccagcucuagaaaguacauguguggaucucucagugagaccuucugcaaauaaugucauugggagacccucuagcuauuugauaacauuagaugagcuuauauucaaagaaacuucaaagcuauuuauucuagaagauucuuaggaagagucagugauuucaaaagaaaucuagacuuacaugcagggauaugcaggguauaaacuuuauugauggcucaggaaacagguuugaaagagcuuccgguacacaaaggggauucuucuacugcagccgcuuuugaaaagcuaaggcagagucagagugaggaacacagaagcauccaaccgcuucugucacguaagcaugcugaggcugcggaaaaagagugcgucugacuguaguccgggagaaagggaugggcuggcagaggaggaggagaaaaugcagaggguacaagucuuguaaaugcucuaauuuuaaaacugacgguaaguuaugccauuucccucuaacaaaaaugagguaggauucgcuauuuucaagguaaaaaaaaaaaaaaaaauccugcguacaaggguaacacuguauaaaauguaugaaauuuaaaaauugauacuuaguauuugcauguacuuaugggguacgugugauguguugagacaaucauagacuguguaaugcccaagucaggguauuuaggguauccgucaucauuaucauuucuuuguguuuggaacauuuuauaucuucucuuguagcuauuuugaaguacgcaauauauuauuauuaacuauagucacccuacuauguucuugaacacuagaaccuauuccuucugucuaacuguauguuuguaugcauuaaccaaccucuccucaucccaccccaccccaccucccaccauacacacgcauaccucuccuagccucagggaacuaucuaaagaaccuagaauuaaagauguauuagucccugcccugacccuuuccagcucuggaagcuuuccugaucuuuccugaguagggcgcuuaacccguggaacacguuuccucuuucugugugaaguaagggguuuggauuaaguaauccccgaggccccuuccuggauucucccuaaggauugguccagagcagaaaccaaugccccggaagauaagcuugaugaccacaccaccgacucuuaccuaagacguugcuucauuaaacauaucugaucaguggaccauaugcuguucuucuguagcauaaauuuugaaugguuuaguugaauuuccgaauaaagcaaggagugggugggcgguggugggaaauccacacugauggugugcucucagaggacgccuccccugauguagcauuuauuuuggagaguuuuguguuuuugagacaggaucuuguucugccaccagguuagaaugcaguggugcauucacaguucacugcagccuugaccuccuggcucaguugauccucccgccucagccuccugaguagcugggacuguaggcauaugccacuaugccuggcaaacuuguaauuuuuggagagaaauuuaaauaggcuguguacuccaugccguguagguacuggggugucacaauagaaaaugauaguauuaugucugcccuagaaguauggcccagucaacguagccccaucauaacaaaaauccaaacacucaggacauuguuaucccuguuguuuuccagagagccguauaaugcacugcuuuuucuuuccugaucaguuuguuugguaggagagaacuguuguucccuguucucccagaaaaugccaauaacugacucacagauugccucaucuccagccaagauucuguuuuguauguaagcaaaguuuuucucuugauacaauaacauguuugaugcaacucacauuuuugcauauuaaguuacugauaaauaagugaaauguuugcuuucaguauuaggaccagucuucgacauuaaggugcucuuguuuuucaccucuuucuuugaaauugcucuaagaugaugaacaucugucgcuugcuacuugucuaaugucucaaucuaaucaaagauucuuucuguuaagaauuugaacuauguggaauaagagcaguaucuugcuguguccuuuccagaaaaauccucagaucauguaucuagaacaggaguuagaaagccugaaagcuguguuagagaucaagaaugagaaacugcaucaacaggacaucaaguuaaugaaaauggagaaacugguauguuuccuucagaaugaaagaggaucuuacaaaugggguaauaugugugaaauugagcccugcauuuuagaacuguggaguuggguuaacugcuccuaaagauauuuagaaauuauacaaaagauaaaguucacauuuucuuuccaaguuuguuccauauuuauucauugcugccuccuagaauguuuucuuuuucaaggaacauguaaaacagcacccaguccuuggaaaaacuacaaacaaaucaggcuuauauuucagugguauuuuggaucuucaccugcauaagaaaaauguuuaaauaucuauguaaaaucaguacuuuaauauaccagccacccuggacagguuucuuagauccaaaacaguuggauacguuuaauagaaaugaauagaaaugaauuuaauagaaaugaauagcaauacuauuuaucaaaauucuucaucuugcuucuugugaauuagcaugugauaaaagaaucgugggcugggcgcaguggcucauuccucuaaugccagcaguuuagggagguugagaugggugggucacuugaggucaggaguucgagaccagccuggccaacauggugaaacccugucucuacuaaaaauauaaaacuuagccgggugugguggugggugccuguaaucccaaguacugggaagguggagguuccauugaggugagauggcaccagugcauuccagccugggcgacauagcaagacuccaucucaaaaaaaaaauugugcuauaauaagauuaauccauuuggacaaguagcagguguuaccaaaaauaugaauuaacauucacuuugcagugucuagaacagagaacgauguuagugugaguggcauguucaguguucagcgucagucuuggcccggcccugaaauacagcugcugccagccaggacucuaaccaaguuggcagaguuuggcaaggcagcuuaagugauccccgcccucgcggugccuugcuguugacuguccagcugccgcaugcuacuggccucuucuccccacagugaugagugacucaggcuucuacaagugccucauucaaacccaaaccagcccuggacaguaggggacaugggggaccucucugcugcuugguuuguguugguuuggcguuugguuuucuucuggagacuaugacuucuguugagggagauaacggccaagccccuguguggauauaccagcauuuugaauuaucaggaaauuuuuguaaaggaaggaaaggaacucaugguuguuaaugggccaaccuaguauacauaccaguuccugccaaaggucguccuguucgacugagucugguaucuucuaaucugguagucagggaugacucagaugauccuguuaauaggacugcuccauaugccauucaugcaucaaaacuuucaaaaaaucaugugcaauaaaucagacuuugcuguaaacuuaccaacacauuuaauuucugaugaucuacuauuuguuucuugccaugccccagagguauccugauaauauccuucagccuugcauuguguaugugugcaagaaugaguugauacaaugagagggagacccacuguucccuucauauuuguaaauuacaggccucugaugaaauuaagagacuuagaagcacaggaaguuuucuaagaaagacagcuuucccaugaaaccggcacugcccauaaucagcucugugacauuauuaggacuaguuucccuaggaugagauauuuaaaggacaauaccucccaaucucaaauuccagguuuuuuuccacguuguuuuaucugggaauccuucauaauuacugaacguagacuccuuuucuggaaagugauuuaaccugaacagguuguccugagcugcuucuggauaacaggaugucuuaagaacaaucagguuccaaacuaagcaacauacucaaagcgcguuaguccugcuacaaggacaaggacuuagacuuaauccugacggagcuauaauauugccucuucauaaagccuuaccuuuagaaagugagugggggauggaaucaggucuucaucauguuaagugauuaaauguccucaggcaucuuauccuuucaucucuccgcugaucaguuuguuugccuugaaaguucagccugcacagggcagcaagagaacagaccuaucuaucuucagcugaccugaggagacucguggcauguuacuucuuugauggcaugcucuaagagcucuaucgaauugaagcuuuguauggccacucagacgcaaaugcugaaaacuuaccaugaaacugaguucaaguccauaguaaacguugccagggacugugaauugcuggccugugaguuuucaucagaugugggaaucuuuuuuuuuuuuuuuccagcaaaauucaccguaaggagauagauaagcuuugauaagugugggcagugugucugcaggguuuauuucacauugaaacagaaagaggcaccaauucuuagagaauuccaaaacaacaugaccuggaacaaaucuguuacccacucguaucaauauuuaaguguccuggcauacauguuuuaaaaauacccagccgcucuguuuugcuguuuuaaaaucuuuuucaguauguuuguuaguguauaaauauuuuaauauggaauugcauuuuccuuaauuaaaucuccaaagugugcuugugucgugaggugccuuaagaaaugagggguuuuuuuuuuaauauuguauaaauguuggaauucuuguuuaugccaagguggacaacaacacagcauugguugacaaauugaagcguuuccagcaggagaaugaagaauugaaagcucggauggacaagcacauggcaaucucaagguaaaaauaaaacagugcuguuucucccgagcuccccgcucccuuggacauccaguguacuuucuggacacgcucuaccccugcaccuccuggaaauaugauggaagcagaugguuaaaagggcauugauuucucuguggaaaauaugauuguaguaguucaugcuuuuaccaaagcggccugaaaacuguacacugagacccaggccagcaagccugcucccacggccucuggcugccucugagaaugcuuucagacaaagagcaacacaaaaccaaauagaaaacagccugcaacauaagguagucauaaaacaugucgaauauuugcaaaaguggcucucagccuacuaugaaauugcccaaaaaguacaguuauuauuauauauuuuuuugagaugaggucucacucuucugcccaggcuggaguacaguggugugaucuuagcuuacugcagccuccaccuccuaggcucgagcaguccucccaccucagccuccugaguagcugggacuacaggcacaugucaccaugcgugacuaauuuuuguauuuuuaauagagacagaguuucgccauguugcccaaguugaucuugaacuccuggccucaaguuauccacccaccuuggccucccaaggugccaggauuaugagcuugagccaccacgcccggccuguguuuggguuuucuuagccagccaaauaccugugaccuugugcaggauucuguuuuaucccaaaggaauaauuuuggacuuuaaaguuucaaacgcuaagaaaaauuuuucaaguuuuuuuuuuuuuuacauagaucucaugguuucuggccuuuuucuucaaggcagcuuuccacggagcaggcuguucugcaagagucgcuggagaaggagucgaaagucaacaagcgacucucuauggaaaacgaggagcuucuguggaaacugcacaauggggaccuguguagccccaagagaucccccacauccuccgccaucccuuugcagucaccaaggaauucgggcuccuucccuagccccagcauuucacccagaugacaccuccccaaaguccacagacucucugaaagcauuuugaugcaggucugcaggacugaccccaaggaggaacgugggcacaagagguauaucagcacacgugugaucaccguaggguaacuggagcgucaccaccggcggaaucgcagcuucugagacuggaacucuggaggaagacuuuugccuccguccaaaagauuccuccaaaaaaagauuuaaaaaaagauuucggcaucgacacggacguuguugcacaaagcacuuaaagaacgagagcaucuuguucauugccuuuuucaccuaagcauagggggaaaaacucucagggcccuauuaagauuuauaaccuuuguaauguucuucaccacagacaccuucuugugaguuuucagucugacuguggggguggggggugugaaugaaauggaugucacagagugucaugugucugaugcagccuccucugcuguguauuaaaugucaaaaucugaauauaucuggauauguacuaaucaaauaauaaucaaucaaucagcauauacauuucagccaaagccauagaagaaaaagcaauaguugcuugaauuaugaucaucuaccaccaacucugcucagcccuguaacaggguagggagaggguauaacaggaagagcuuugacuugucccugucuauacauucucuguaucuuuuggggguaacuucuuggcaguuuuucaguguucagccaugucaguugaaacuagauuuuucuguagauuuuuuacuuacccaugugagccuaacacuauccuguaauucauuuucucaggcuauguguaaauguagaacccuaauuuuucuauaaaaaaacaaacuaacuaacuaacuguguaaagaaagaaaaagggaaguaccaauggguuuuuccaccuuauuuuuaccuuugaucuacccuugcagauuuaaccugucuucuucccucccauuauucucauuuuccuuuuaccuuucuccaccauccagagccacaaaagcaaaccuucuaccuccuaccuacuuuucucugggacaaggauaaaggaauaugauuuuccagagccccagagccagcucaucuuccaggugcugaaaccacuuuccaaauaaacuaaagccuggauuugauauuacaaauuuugggaaaucuuagaauaaagaacgagaacaaggaagucauuggcuaguauaauuaagaaagguaggauucagugcuuaccgaugaugcaguacuugauagaagaaaacagucugggaggauagcgcucauuuuucaguuacccuuuaaggagucccuuugucuuugggaaaguagcagaaugguccgcuucuuucccaugaguggaaaauguggcuuguccaacucuccuccagguugcauuucaguuucuuuccaaaacuuauuaccuccccuaauccugagacuuuggaaaagguggaaggaagaacuguugcuuuaucucccccucccugcaugugucaacauugugaugucaguauuuacuaaucuacauucaguggcuguacaaauaacagcuguaguaagaagagauucaggaugcuagaggugaauauuugggucauuuacauguacacuacauagcaaguugauacucauguugcauguucuuuuaaauuagugauuuugugucuuaagucuuuaacuuccaauacuucaucauguauguaaccuuccauguuugcuucugauaaauggaaauguagguucacugccacuucaugagauaucucugcucacgcuuccaaguuguucucaaugacauuagccaaaguuggguuugccauucauccccuaggcaugguaaaucuuguguuguucccugcuguccuccguauuacgugaccggcaaauaaaucucauagcaguuaauauaaaacaucuuuggaggaugggagagaacaggagggaagaugggaaacaaaauagagaauucuuaagauuuuguuuaaaccaaauguuucauguagaaugcaaaauguuggcacgucaaaaauaugaauguguagacaacuguaguugugcucaguuuguagugaugggaaguguauuuuacucugaucaaauaaauaaugcuggaauacucaagaauugcauccucugaccuacuucauucuucaaauucuucauuuuuacagcccugugacagcacaguaaaggucguaucuccucuuaguuuauauuucccaggaauuuccacugcaaccgcagaguuggucaugggcucacagagcuagagugagagguaagcucuucuucucuaaauucaaagcuaucuauguuugacaaauaaauuuuggcuggcuguaacaauuucugcuguauaagaaaauuggacaaacuugguaaauauuuuugaauaucguaaaaaaugucuaaacaaaguugaauguucuuaaucuaugcaucuauuucauauugaaagcuaaacuucuaaaaacuuguucuaguuauugaauagacuaaucuacaauuacaccuuugagugcagcaguuuaaaaaaaugaaguguccuugaauuuuuucaguaccuucauaaauuaacucacauuuguuaaaguugcuacuaagacaaaaugacauuucuaagcauuugagu

SEQ ID NO: 21445 - RNA, 122052 nt, Homo sapiens
uuaagcaauggggagacauuuggcuuugcuccugcuucugcuccuucucuuccaacauuuuggagacagugauggcagccaacgacuugaacagacuccucugcaguuuacacaccucgaguacaacgucaccgugcaggagaacucugcagcuaagacuuauguggggcauccugucaagauggguguuuacauuacacauccagcgugggaaguaagguacaaaauuguuuccggagacagugaaaaccuguucaaagcugaagaguacauucucggagacuuuugcuuucuaagaauaaggaccaaaggaggaaauacagcuauucuuaauagagaagugaaggaucacuacacauugauagugaaagcacuugaaaaaaauacuaauguggaggcgcgaacaaaggucagggugcaggugcuggauacaaaugacuugagaccguuauucucacccaccucauacagcguuucuuuaccugaaaacacagcuauaaggaccaguaucgcaagagucagcgccacggaugcagacauaggaaccaacggggaauuuuacuacaguuuuaaagaucgaacagauauguuugcuauucacccaaccaguggugugauaguguuaacugguagacuugauuaccuagagaccaagcucuaugagauggaaauccucgcugcggaccguggcaugaaguuguaugggagcaguggcaucagcagcauggccaagcuaacggugcacaucgaacaggccaaugaaugugcuccggugauaacagcagugacauugucaccaucagaacuggacagggacccagcauaugcaauugugacaguggaugacugcgaucagggugccaauggugacauagcaucuuuaagcaucguggcaggugaccuucuccagcaguuuagaacagugagguccuuuccagggaguaaggaguauaaagucaaagccaucgguggcauugauugggacagucauccuuucggcuacaaucucacacuacaggcuaaagauaaaggaacuccgccccaguucucuucuguuaaagucauucacgugacuucuccacaguucaaagccgggccagucaaguuugaaaaggauguuuacagagcagaaauaagugaauuugcuccucccaacacaccuguggucaugguaaaggccauuccugcuuauucccauuugagguauguuuuuaaaaguacaccuggaaaagcuaaauucaguuuaaauuacaacacuggucucauuucuauuuuagaaccaguuaaaagacagcaggcagcccauuuugaacuugaaguaacaacaagugacagaaaagcguccaccaaggucuuggugaaagucuuaggugcaaauagcaaucccccugaauuuacccagacagcguacaaagcugcuuuugaugagaacgugcccauugguacuacugucaugagccugagugccguagacccugaugagggugagaacggguacgugacauacaguaucgcaaauuuaaaucaugugccguuugcgauugaccauuucacuggugccgugaguacgucagaaaaccuggacuacgaacugaugccucggguuuauacucugaggauucgugcaucagacuggggcuugccguaccgccgggaagucgaaguccuugcuacaauuacucucaauaacuugaaugacaacacaccuuuguuugagaaaauaaauugugaagggacaauucccagagaucuaggcgugggagagcaaauaaccacuguuucugcuauugaugcagaugaacuucaguugguacaguaucagauugaagcuggaaaugaacuggauuucuuuaguuuaaaccccaacucggggguauugucauuaaagcgaucgcuaauggauggcuuaggugcaaaggugucuuuccacagucugagaaucacagcuacagauggagaaaauuuugccacaccauuauauaucaacauaacaguggcugccagucacaagcugguaaacuugcagugugaagagacugguguugccaaaaugcuggcagagaagcuccugcaggcaaauaaauuacacaaccagggagagguggaggauauuuucuucgauucucacucugucaaugcucacauaccgcaguuuagaagcacucuuccgacugguauucagguaaaggaaaaccagccuguggguuccaguguaauuuucaugaacuccacugaccuugacacuggcuucaauggaaaacuggucuaugcuguuucuggaggaaaugaggauaguugcuucaugauugauauggaaacaggaaugcugaaaauuuuaucuccucuugaccgugaaacaacagacaaauacacccugaauauuaccgucuaugaccuugggauaccccagaaggcugcguggcgucuucuacaugucgugguugucgaugccaaugauaauccacccgaguuuuuacaggagagcuauuuuguggaagugagugaagacaaggagguacauagugaaaucauccagguugaagccacagauaaagaccuggggcccaacggacacgugacguacucaauuguuacagacacagacacauuuucaauugacagcgugacggguguuguuaacaucgcacgcccucuggaucgagagcugcagcaugagcacuccuuaaagauugaggccagggaccaagccagagaagagccucagcuguucuccacugucguugugaaaguaucacuagaagauguuaaugacaacccaccuacauuuauuccaccuaauuaucgugugaaaguccgagaggaucuuccagaaggaaccgucaucaugugguuagaagcccacgauccugauuuaggucagucuggucaggugagauacagccuucuggaccacggagaaggaaacuucgauguggauaaacucaguggagcaguuaggaucguccagcaguuggacuuugagaagaagcaaguguauaaucucacugugagggccaaagacaagggaaagccaguuucucugucuucuacuugcuauguugaaguugaggugguugaugugaaugagaaccugcacccacccguguuuuccagcuuuguggaaaaggggacagugaaagaagaugcaccuguugguucauugguaaugacggugucggcucaugaugaggacgccagaagagauggggagauccgauacuccauuagagauggcucuggcguugguguuuucaaaauaggugaagagacagguaaauauguuuuuauugcucucauuugaugcccuuuuccauuuuuuuuuuuuuuuuaaccaucugcccuguggcagcuucuucaaaauucccuguugcucuuugggcucgguauagaagugcgugugaauauuuuuuuuggcccggcugcuguauuguagauguguuuauucguaguaagccaugaagauggaaacaaaagggccugagugauuuaaguggcguaaagugaguaaaagaccagggauacauugaaauuguuaucacugauacugaucuccaaacucuauuuugaacucuauuaucaaaagcaucauuaugguuuuguucugacuuugagaagucuuuccaacuuuuuucagucaguguauuugcaggcucauacuuagaacaacuacugcuaccaucuggcgugccauucagagguuguugcacaccggcaaaguuacccagugcagagaugaugugccaaaacuucucuaauguggucuucacuuaguaccucgucuagguuuuggucgagaggcagaggcgggguaguggcaugcugaacugagaagaccuggcuuggaauccuggcucuucuaguugguaauuggugauccuggacaagcaaaugacuucuuagaacuaacuuuuuccucuucuacauggggacacuuagaaauaccggaagguuuaagugagaguaaagugaaauaacacgggaaaacuccugacgugugguagguuuauucaugguagcagugcuuuguuguaauacugaagguucugaaaccgggaccuccaaggcagcaguccaagcuagaaagugcguguguugcacuuuguacauaccucagucuugcugcgcagauauuguaguuauaugucaauauguccugguggagugugagccuuucggggcaggcuuuuagccccugcaucuucuguguuuagcaccuagcaaaaagugccuggcacauagaagcuggucaaucaguguuaaaagacugcaggaguaaaugagcgaauguguuggcuuuucauguccugcccucugagaaugauaguggaaauagaaaaggggugaucauagcacucaucagcaauagguggggcucaauuuguuuacuaaucucacccauguguacuuuauaaaucugugcauuuuaaaagggaccuuuuuaaaauuaccuuuaaacuuuauauauucaguaauaccacacacacaaaaaaacaagagagucuucagucaacacccacccugggauccaugccaucugauagguguguagcacaugaaaaauguaacugcuguuuagaaaaacauuauuuugggcugggugcgauggcucacgccuguaaucgcagcacuuugggaggcgcaggugggaggauugcuugaggccaggaguucaagaccagccuggguaacagcaaaaccucguuccuaccaaaaaaaaaaaaaaaaaaaugcugggguggugguacaccuguagucccagcuacuugggaggcugaggugggaggauggcuugaguccaggaggucgaggcuggagugagcugugauugugccguugcacuccagccugggcaacagagccagacuaucucaaaaaaaaaaaaaaaaaaaaaguuauuuuggaaguuguaauauauuuuuugugcuucuauuaaugcaaggaauucuuucucuguugguuaugugccacuagcauauggccuauguauuaagucuacagacuauauaucacuaucuaaaauacccauaauuaguuuauuucaagagaaacuagcauaaucaacagcauuugauaauccucugaagaguagaaugucuuuuuuaucauuuuaucuguccaguauaaguuagaauuuucaaauacuguuucaacauagaaaaauaccccaaauuuaacaacugaagcugagucaaacuguuuuuguaaaauuuuugaagaacaguuauuccuacuuuuuuuccuucuccaaaguagguuucaaaagccuauaaagaacuguuaaaaguuaaaguugagacaaaauggaaccaaaaccuuaauuuaaauucucuucaugacuuuguaugaacacugccuuuuggguuuuuucuuucaagugaagaagaguauuuuuauuguugcuuuuuaaggaaucauuucgaaacuaguauuuuucaccuacacauuuaagagauugggauauuuuuacuaccaagaaaaaaaaaauaaggaaacaaccagccaaacgagguggugucccaaaauagauuuaugguauuuuccagaaagggcagugccagacuuuuccaguaguaauuuagugggaggcggggagguguugggauugugggcagugugguugguaaguauauaagaaacuguguguaaauauugagauuuaaaggugagagagaagcuggaaauuuguaggucauuuauucugugguccuugcuuuacagagaaaguaaguaguguacaguagacuuacguuuauaugcuuuuggaaaugaacaaaagugauagaauaauauuuacacauuggaccucguauucauuacaagauacauuuuuuggcagaagaauuaucagcccaaguuauuucuucagagauuccuggcaggacaauugguaucacaguguagaaacuccuuuaggaaaaaucaguauauuuuguuggcuaaaauuaggcaugcuaauuauucacuuggagugugucuuaacuaauuucuagggcaugaaggaaguguggaaagaugcgugucaggugaagagauggaggggcaguugaggaacacccgugggggcugccagagacugcacuacagcuuggugugccuuggcgugcacccggcccaggccaggcuggugcuugcuggaacuucgcuccuugcccauugcccauguccaccagggucuucuuugccuaacucgggggcauuuaauauugcgcuaauuaauaugagccugugcaggagugcuguggcucuggggaccaacaaccuguccacguaacuguuugcuucuugucuuugacuuaaagcuacuaguguugguugaguauuauaaccaaauuuuugucauauuuuaccuauuucaaccuagucaaauauguguaucauuuauauacuuuucacagaacagagaaccuauccagcaagcugaaugaaguucuauuuuaagaucuuuccuuuucuucucuuuaaaucugcuuaaauuggaaacauccucugaaacguaguuuucuguuuuuguagaaguagaaauucuauggacuaccuaaaaaucugucaccaaacggacaguccuguuagcucuguguucuuagcuccgugguuuguacauguucugcaaauggcuuugcagcgagagaaagcguaguggcagaguggggauggcgggcguggacucugcaggucucacgguaucaucugcccuuccuggagaggccucuggauguuggugaacuguucugacagauccaugccacgugacugcccuuccaugugaggucuggaaggggagagggccaugugaacaauuauuuggaaagucggucucguuagagagccaguuuccagagcucuaauuaagauucuccuccucagauugcuaucuguaaggucuacagugaggauuauaaaguagauuuaacaaagauguuuagcggaguaaagaucuuugaagcauguguaaucccacauucaggguucggucugccugccaugcgucucagcauccaacccccucuucuacuucagauccauucucuguugcuuuguuguaagcuucaacagguuuuccuguaauuuaagcagaauaaaaucuggagcaucccucuuguggguguguggaauaaauuugguguaguguucuuagcugauguguacuuagcaaguuaauuauuacuugagcaccaaugaaaugcugcagcuuuuuguucauuuuuaaaacuaagggaaugucuagaaaaaugccuggccagaagauuuuguagaaauugugaauagaaguugguguugaagcaguguuggguugaggucuguucccugauguguguauugcguacaggacgcccuggaauguguuugaccuucagucuagaguaguuugguucucuuuuuggcuguuaauguuaguauacaaagcagcccaggacgaguguuuccccuucugacucuacuuauuuggggagcccguguuuuucauuaagauaagagcagaucucuaaacauauuacugcuguguuacuuuuagcaucccaauccugguuucaggauugaaauuuacguuuugaugaaaagacugggaaugaauuaauauggaaguacagccguugucacaacuuaagucagcauucaugaaauacaggaagggaaaugaggacauuuuucuuaagagaaaauggcugcauucacacgauggagaguguuggagcaccaucccugugucaccuguguggaggccggcuccuggccucaugucugugucaccuguguggaggucggcuccuggccucaucccugugucaccugugugggggucggcuccuggccucaugucugugucaccugugugggggucggcuccuggccucaucccugugucaccuguguggggucggcuccuggccgcccggcuuaggugcacacaggugagugcguuucuacagugggaacggaacggaauuccggcccaggcuaaccugauuguugaccucagucagggaaaauguuucuggagcuucugucugguucugcagaacucugaauguuucagcuauuuauuauucauucaaguuagaaacccuuuuccucauauaaaguaggauauuuuacuuacauccugggaucccugcuccugcugcacguccuccugugacaggagaaggaauguggaggaggcugacgggccccggauccugacuaaagggucugcaaguggcugagagcuggguggcugcuggaagccuggccugcuguggugggaccugaugcccugugggagcuggggcuagaauuccuggcagcaggaacuugauuagagacgggugggaggcccggcagagaguuaaaaaaugugcuggugaaagggcuuuuguguugcuggcuccucccugaaguggcagcagcugcuguccucuuggcucuuuauguucuccuccuaggaaagcuuaagagaaaagaagcucguuucccagccacagggagacuggaaguugugucuuggcagaaaugauguuaccacaguguguuguugcuguguucugggauaaaaaucuugugugugugugauucugagucaagcagggcgugguaacaauuucuaccaggggaaggguccuucuuugaagcaggaagauguuaaggugaaaauaggaucuagucgaaauccuaaggaaguuccauuuucuuacuaaaaacaacagagauucagcuuuucuuuaguuauuuguaugauguuuaccacguugaugcguuacugacugaacaagucuagccuggaaaggcuguggaugggaacucgggggaccgugacucagggccgucccacguuguggagcagcacgcagugacgcuuaccgugcugugauguaauucucagagugugcaggggccgggaccuggaggugugggguggaaacagcuuacgucagacaggccggcuuuguccucaugcugucagugguaaugacacugguggugagcaccagucuaguaauaaccacgacacugagugucacagccgggcacugggcccggcauucugugugugccaguccauuuaauucucacaaccaccggguggacucuguuaucccuacauuacaggaugaaacgucaaugagagguuaaguaacuugcccaagacuucuugggugcuaagugccagaaccgcauuuuacuccucuuacucuuugaagaaugaucuacggaugcugcgagggagccuguucaaaaacgacuagugaaguggguuucugugcuaagcuggguuaggccagguugcagccuugaauccuagauucgaugcuugguccugaaggagucuugaauguaagaaucuuccagcauuuuuacucugaaugacauauugcuaucuagcacaauuaggaggacaggaguuugaauuccgucgcgguggcagucagcaagucaagaucaggccagcgaaggcgugggugaauccaggugagugccuguagcuucccuugucucauuggccauugaagagauggacaggugucauauuuguguuugcaguuguaaaagugugauuuaaucgguaaaaaugcugcccaucugaacuggacaggacguuaauuguuggaaggcuuuucuuguggaaaccauguuuaagauggugguuaggucccagcuuucaggccugcacgccaaagcuaacgugauuuguaccucccucugcaucgaguuacaugaggccaucguucucuugccuuguccuccuuggugccuuggcaucagcagcuguccucuuggccaucuaguacggggcaagaaagccagaguaagcuuacucaccgucccccuugccagggaacuguuuuuuguccuaaggauguuuaaggauuggguguucguaauuuguugagugaccuguguguguagagguuuaauguucacuuaauaccuggucuguucuuuccguauuaccuaccguguacaacuaugaaaauugaaaagauuuuaagcuuuagguguuaguuuaaauguuggagauuuucuuaccauuuaguucccauuguuuuuacuuuuuggauuauuuuaguucguagggcuggauuugucacguuuuuauuuauuaguguguguuuuguguacuguuauuuugcaguugccuuucuggcauuuuuuuuuuuuuuucaaacagcagaccaugcugcuuauaaauagugcaugcuccauacaagacauagugccacaaagcgcaaucuuuucugucuuuguuacuaggaauaaauggacuuggaaagauugccguucaagggcacaugccuguacuuguugaauuggcaguucuccaguuucacagcagugacaguaagucuaggaaacuauucacauauauacuucaagggccagucuuaucaauuaacuugccuugccaguucaacaguaccauaucuccucgaauaucugauaccauguugaacucgguccauugcuaggccuccgaguggcucaaccuguugaaugggauucuuuagaaugucuuacucauuucauguuggggagagucuacuaauacagucuuuuuaguuuuaaaucaauugguuuuuuguuuuuuuuuaauaaaaguuacucagcuauuuauguaguuucugaagacugcuuucugguuugugauaauuuaaccauauucuuaucacagguaagcuuuuucuucuuaaucaucaucagcauguaauuauaguuaacguuuagugaguacuugccguguacaggcccuauuuuauggucuuuccauagacugucucacuagauugucacaauuagugaguaaaauuacgugguguuauacucugcucauggaguucaugucugugccaaauuauaaaaacacgacaaaugauggaaauaugaugcacgucgacuuagugccauugaauuuugaaauauucuguugcauuuuuuaaaggaaaguagcgcgugccaguugauguaguuuauggugugaugcguuaggaggcauucugacaauacagacgugauucuugagcugagguguucaucugucacggaauccuccuuaacccguuucacugucucccaucgcacgggguccagucucuccguggcggagccgcauugcccuaacaggccucccugcucucccauuuaacaucacccgugcuucccucacuggcuccugugcagcccuggucccucagccccugcccugugcagcccucuaccccucugugccucgccguuuucugucucccugccuuugggcauacaguggucagcucguauuaucucauaacucuacuuaauaaagcuuucuugacagcccucuucguuacguggagcuguuucuuaucuuuuauguacuuaaacauaugacugcaguaucacucuaguguaauuguuuauuuacacgcgccuuuccucuagauugucagcucuuugugggcgcacguaagucuuugaaugcuugguguauauaacaggcacucaaugcauaaugguuaggcuggccugguaagccaucguggggucuccggggaaaccuuuccuucaagccagguagccuuugcuucucuucgcugcgggggcacuuccuguguguuccucuguuguaguguaugacucagugcgcggccugucugugacuucaguccgucuccaugaacucaaggacacaguccagcguaaucaucugucuacccucuucuaagcacaguggcugauagagcaguaaguagcccucauuuguuuugugagcaaauagauuguaacacacaguaauugcaguugugaagguugagcgaagcuucuuuucugccacccuggacgccuauuuguaggcuccaaaacugugguucuugaugguuuuggcgucacagaaacuuugagaaucuguggaaagcuguauauucuuucuucagagagacagugauuugauucaauaccaaggggcucagugaagugccgaaccuguguucaugcacugaccgucuucuuggaauccugguuuugagauccucuguucuggagguuccaggguugucaguccucacaaauucucauaaaggaggaccagcggguaaggauaauggugaugaugaugauggcagugaugacagugacagugacaagcauuuuuauaaugccuuacaaccugcaaguauuucuacauacauuauauggugcuuaauguaauagagaaauaaaaccuguauaaaaauuauaaaugagcuagauaaaccuuaacaauggacaggucacuuuucuauauauuuguacaugugccugaaaugauuuaggagaaaccgucauucaaggcuguuuccaagugaaauaagaaccuguaguucuuuauacaccuguuucaucagauguucugucuccccauugaggcauacggcacaaauaaaacagauauaaugaacagugugcaucaucccucggagagcauggggaucgguuucuggaccguccgcgcacacccacaucugugcguucugaggucccgcagccggcccuccacagacgcugcgcuuucgcgugcugugaguacuguguuuuugauuugccuucaguugaaaagaguucauguguaaaugggccugugcaguucaaacucguguuguccaagggucauugauaccucguuuaaguuaagcagcuuucuaggccaggcuuuggucuuuaguuuugccagcucaccauggaaaacccuuaaugccacaccacuaguauuccuuuacuuauuaaggcaaucugucaggaaacucaggccucuaaugauaaaguuagcucccuuggcagacagaauuaauuaauuaauuaauuaauuauuuucuaagacagagucuugcuuuguugccaaggccagagucgaguugcaguggcucaaucucugccugcugcagccugcaccuccaaguugaagugauucuccugccucagccucccaaguagcugggauuacaggugugcaccaccacacccagcuaauuuuucuguuuuuacuagagacgaguuuuugcuguguuggccaggcuggucucgaacuccugaucucaagugaucugcccaccuuggcuucccaaaguguuggaauuacaggcgugagccacugugcccaguccagaauuuuuauuuaaauggacuugccguauguucuuugaccucuauggaaaauagcccugccauaaguucuuaguuaaaagauucuccaaaaugcauuuguggguccugguuugcuuuuagcuuucuauuaauuuuuuuacuugccucuuuauucuuagggcugcuugacauuacucugucucagacguccguguuccucuuaucacagugcuuggcacagggcugguaccgaguagcugccugcucaggggguguucaucuuuucauagauccugugcauguuugucccaugauccucuucuuucgauuuguugcccagcugaagguguuuacauauuuaagugaaaaaaggcggguuugucauguaaauaccaaguuagucuguugguugaggcaacaaaauggaaaucaguuauuuuuuaaggaucuaaaaaauuuuaaaaggaagugcuuuuucuuaauaguguggcaagcucauuuagaagauggaaacugauuaggaaaguaugaacaugaguaauauccauaugugguuuuaauuggcagaauguugauuucagaaagaagucacacgaaguuucauaucuacaaaguaucaagauuagaguuuaaggucaguaauuuuuaaaauaaguguucuagggccuauggccgggcgcuguggcucccgccuguaaucccaacacuuugggaggugaaggcgggcggaucaucugaggucaggaguucaagaucagccuggccaacauggugaaacccugucucuacuaaaaauacaaaauuagcugggccuaguggcgcacaccuguagucucagcugcuccagaggcugaggcaggagaauugcuugaaucugggagcuggagguugcagugagucgagauugugccacugcccuucagccugggggacaagagugaaacuccgucucaaaaauguguguguguguguguguguguguguguguguguguguguguuuuauauauaauacauauuaaaaauuauuuuagcauguuuaaaaaaucugcuuuugucauuugacuuccaccagaauauaaggcugaaacuggacucuguccgugucuguaucacuuacuuaggaacugacuggcaucuaggcauccagccaauacugguugaaugcguaaaauuuaaaauggaaauagauuguaacaaaauacuaaagggaaacgcuuaucuaaauaacuauuguugagaaagcccuuuuaaauuuguccuuuuuaauauaguuaaggcugcucuuccacuugagacacccugucucccauaccuuccaaaauuacaagaauaagaacaacaaagcaguuuaguagcaaugcggguuccucuuuguuucugcuuugcuuaccuaggagcagccuccuuugugagauugaguaucuagauucugaggcuggccuuccaggugaauauaccugaguuacguguuguguccuugggcuguagaguagugcuauugccuguaucauccucuggauugaaaaguauuucuuuuguuuuaaguauaaaagaugaguauccauugccauugcacauuauucagcaaaaacuugaacucuaaaaaacguucagauuaguaggaucuauuuuuguuaguaucauuauugaugaauuucuuaaaacuuaagaaaauaguuacuucuagagauucacagauuauuuuugaaacuguugguuuucuggauuaaauugagcucacccaacuauccuuugaaaaagcuguuuuguauuuuuguuuuguuuuguuuuuguuuugagauggagucucgcucuguugcccaggcuggagugcaguggcacgaucuuggcucccugcaaccucugccuccuggguucaagcgauucuucugcuucagccucccaaguagcugggauuacaggcacccgccaucaugccuggcuaauuuuuguauuuuuuguagagacgggguuucaccauguuggcuagcugaucaugaacuccugaccucaggugaucugccuuccucagccuccugaaaugcugggauuacuggugugaaccacuguacccagccuguuuuguauuuuaagugucuugguuacuucuguggagaggugcaauuuacuuaaaaccaaacacuuucuuuuaaagggugguugaauaauggggggaaauuuaguuaguuaccagacucuuuuaagaaaaauaauauguauguaaacuaaaaguaguuuucuuauuuuaguaacuacaucuaaguaaaaguuuuuuaaaaacucauuuguucuuugucaacucuucuugcuacuuaggaacucugauucuaaaccuuccacucauauaaauagaaaauuaucaguagcuaguucaguuaacuucauuauucuauuuaaaaguaacucuuuaggaugauuaaaggaaggaaaggaaaccguuguggaaguuguucacuguguauuugaguagaaaucuguucauagcaaguugcauuugagagagguugagcguuaugagaaauggggagauggugguuagguuaggugagaggcagguugaguuugggagauguugaguuucguuagaaauaggaagauggugguuggauuaguagaugagaggcagguugagucugggagagguugaguguugugagaaauaggaagaugguggauggguuagaugagaggcaggucgagcuugugagauguugaguuuugugagaaauaggaagauggugguuggauuaguagaugagaggcagguugaguuugggagagguugaguguugugaagaguggggagauggugguuggguuagaugagaggcagguugagucugggagagguugaaucuugugaggaauguggagauggcuguuagguuagaugaaauacaugagaaacucaaguggaauaaguguaggcaaauccagagcugaacugaaacguuuuauugucuuugggccaauauuaaguauugugaaggaaauuacagagaauggcauuuagccuuuuguugggaaacaaaccaucccaaaaccucauagcuuagaacagccuccacucauuugggucaccguucugugggugggcgauuugggcugggcucagcuggguguuuccuuggcuguuuuccacgggcugacucauguuugaucaguugcuguugagcucgagggcccugcucccaggagguggcuggguguucgcugcaggcagcagcuccuaggcccugugucugugaucaucccgcagccuguccuggacccguuuacaugguggucucgggguucugggugcucgaggaaagcagcaaauccgcugggccaaggcucagaacuccuccacugucaucucccacgugcugugacacaguucguucauccagccacagguagggagguaggcuaaccuugcugagaggagcugccgaguacuguguucauguuccuacuuccagaggcacuuuuacccgauugcguuucccuuugagggaaucccuucugaauguuaaaugugcauuacuauauaaaggcuugugaaaauugugaaaauaucaauauggucuuaaaacuuuucugucuuacauaacgauacuuuaaguuugucauacuguucaaacauguaauggcauuacaguauaucuucaaguuauuuuuagcacauuuccauuuaaacuagaacguaagcagagauaccagggggaugcuugaagucugaagauaccaaagcaaugcuccuccaucgucuuccuacuucauuuucuaucacaaagaucucugaaguuucuuacccccaaaggaauuggagaauuccaguuaucguguuucuaaagugaaaggcggagagauggagugucugguaaagggcagcaagggguucuucacgauagacuuuggccugcagauguucguuuuucucauuagcaccacuuccugcuaauuaauuugucacaaacuaucucauugauuuauugcugucccguagagaauggaauacuuggggaaauggaauuggaaguccauggaagacuggggggcguggaaauagacaccgaaaugaggagagaauauaggaguguugauuugguaucuuuagguuucaugcagcccucugacaucucugcuuaaguuucagcuuaaauggaaaaguuuuaaaaauaaccuaagauucccagcacuuugggaggccgaggcgggcggaucacgaggucaggagaucgagaccauccuggcuaacacggugaaaccccgucucuacuaaaaauacaaaaaauuagccgggcgugguggcgggcgccuguagucccagcuacucgggaggcugaggcaggagaauggcgugaacccgggaggcggagcuugcagugaaccgagauugcgccacugcacuccagccugggcgacagagcgagacuccgucucaaaaaaauaaauaaauaaauaaauaaccuaagauguauuuuaauaccacuuaguauuuugcuaauuuuagcuuauauuagaguuguuuguuacgggacguaugugcaacaguuaauaggaaagugcucugugguaaguugaaauagaaaucuuaggauuugaaauagaaacguguaacuguauugacucacuaagcauuuugacauuauuucuguuuggaaauuuugggaguggaugucuuugaacacauugacauauacaugggggggaagaaaaacaaacuuguggccuucuuuaacagagauuuuuagagaaguaguaagucccagcugccauucuucuccucaaagagauuagaaaaagaaccacauaaaaauaaucauuauuauagguaaaaaaaaauaguagccacaguaaagcauacauguuuauuguuuacugcuuguagaaagguucagugaucauuaaaugucagaacgaaucgucuuguuucuguuuuuuuuaauauuuuauuuuguuuuuauuuagagaugggaucucacuuucucagacuggaguacaguggcacaaucagggcuuacugcagccuugaacuccggggcucaagcaauccucccaccacagccuccugaguagcugggacuacaggcauaugccaccaugcccggcuaauuuuuuuuacuuuuuuugcagagguggggucuugcuauguugcccaggcuggucucgaacuccucagcucaagugauccauccuacuaccuuggccucccaaagcgcugacauuacagaugugagccaacaugccugucacgccuggcucaguggccuuguuucuaacaaaaaauuuucucaugaaaugaaaugaagauucuguaacaaguuaguugacaaacuuuguuagaaaccuaauguagagauggugacuuaaaaugugauauucucauaaacaguaagucuuggauauaguauauagaagaucauguuagcgaagagaauaaaagucuuaaauuguuucuuuugguguuagagaugaaucugcacuagaggcaccuaaucagcacgguguacucuguauaagcuaaaacaaaacacaacagugauucaugucccagaguagaccaugaaaccacuuauuagaaauauuccaaaguuuacuguuuuuagauacaggugcucauaugugaaaggugaacugauuuuuacaauuuauauuaacaaaauugugcaaauucugccacuuuuuaccguuacucguuauuuuuuaaaucaaaugaauuaguauaacaggucaaaagcagcacugcccaauaguacugucuuuauuuguaauuuuauauauuuuaguagccacaauaaaaaagaauauaacagaugaaauuuuaauaauauauuuuauuuaguccaacauaucaaaaaguacaauuacagcaugugauuagcguaaguauuaaugagaccuuuaacauucauuuuuuccuaugaagucuuuaaaucaguguauauuccacccuuacagcaaauuucaguuucgacuagccccauuucaaaugcaaguuuagagacuuauguagaguucaacugccuuaaagauauuugugacuuuaaauuuggauagugggcuacuagauuuuuuuuuuuugaggcagagucucacucugucgcccaggcuggagugcaguagcgugaucucugcucacugcaacuccuggguucaagugauucuccuaccucagucucccaaguagcugggauuacaggugugagccaccacaccuagcuaaauuuuuguauuuuuauuagagacggaguuuuaccauguugguuaggcuggucaccaacucuggaccucagaugaucugccugccucggccuccaggugcugggauuacagacgugagccaccgugcaggcuauuagauuuucuucugugaaugacguacacgaaauaagugaccuagagcuacgucucugaucauucacuuugguuauaauuuuuuugcaaauuaccuaugcuggaaucuuuugggguuggugggaaugguuuuguuucugauuguuuuuacuuccucaacuguccuaagauuaccagcauucuaaugaauaguaaacuugagauaacggcuucaugccuaacaaguauaauuuaucucuguagucucaaguguuugcucuucuuuuuaaaauguuucuuuuuagagaaauacagcuuugaauucuacuacacuuuucuguaacgcaaugcaguaacauguuuuuuguuuauuuguagcuauccuauagggauagggaaaauguaauugaauaguaacugaggaaggggcuacuaaaaccugagaaaaaaugauaggaaaguuacucuuucccuucauuugggugaugggaaaaaguagguaugagaucuucuaaugggcuugugagugcgguagucuuuuuaaagagucacaugguguguuaauuuuccucuggauauuaagagaucaccaccaacaaagcaaggcuugaucgcccaggugagguggugugcggagucgagucguguggcgggugugcaugcccuugugggaaaggaaguggaagaguuaaguaguucugccuguugaauuagccuggugugggugggugccagauacccugggcuaaggacauucaaugaggauguuaaaagccuauuacacugguguugcugaaaauuuauuuguugaagaggcugguggccuagauccuggcauggcuuuaaaaauauuacagugaagcaauucuugugauguuaagcgagugugugagcucauuuuggagucuuuugacuuggacucucucucgcuuugguuaaugaguguggaaaaacagcccagaaguuaauuuaaaaucagacuuuguuuucaauuaaaaauuguccaugaugggucauuggaugugaaugcaaaaagaaaaaaaauguccagugauagcuuuuguaaaauuccgaguaaaucaugugucuuuuugaggauaaacauuuguuauugaaguucccucauuuaaauagcuuuuuggggggcauaauuuggauuuguagcauaauucuaauuugauuugacguacaagauacaaaucuucuuuaugugaaaguauaugacaucuuaaagugauauuuuuacagagugauuuuccaaaagauuuauuuagaccagguccaucauuuccaagugaagugaaaucuuuauucauuaacuguaaaguuucugugggcuuccacaauugcuaacauguauaauuaauucaaaacccaugcuuuucacacuucuuuuugaaaaguaguugcuuucuguaaacuugaccuuucuguuguuucaauggccuguuuauucuuuucagaguuaaaaaggucauuuucagguuuauggaauuuuccauguaaauuuugggaucugcaugcuggggugauuuucugcuuuauauuuauugcgguacuuuuuguguccuuggguuuaaacgaauacagguuaugaaaaccuacccugccacauuguggcugcugccuuuguaucucacagauacaccuguuucauuugggcuucaucaguuucacgucaagaguugugacugaagcuuaaguaaauauguuuauuuugugccggcugcuggcuggaaagucuacuguagcagcugaaggguguguguuuuuuugggggggggcgggggggguacucuugcugggugaaccaucauugugacagguaaauggaauucgucaauaaagcuugaauugcgucccccuucauuucuuccgagcuguugaauguagggauugucuugcuuggaacccuauugauuaggucacagccuggucugcagaaaacagagcugcccaggggccaucucacugcaggggauuugccgaagccccugugaaaggaccacaugggguccgcgauuaccuuaugaacaggaaucaguucagggagcagauacauauuaaggaccuauuaacuucuacaggcuucucuuugacuugagaagcacuggagagugaagauuccuucacacauaaugaaaggaaauuauugccaaagccaccgaaggugcaucuugccauaucucugugggugccucuguugaguugcaaauuuauuuccugcuggggcaucugcuuagcuuuagaagucccauuuaaggucaugaaaagggaauuuggaaaugauuacauaguguuggcuuuuuuuuuuuuuuuuuuucagcuuugagucuccauagcauuuggacagaauuagcgaacuccccucauuaaaaaaaugaucuuuauuuccaauaaaaaggcaguauauagucauuguagaagccugggaaaauguaaacuacuggaaaggagaaaacaugacuaaaauuuuacuaccuagaacccuggugaacuuuuccccuaacucauauguaccugcacaaagaugccuuuccagugccaggugcgggauuuguaaaaaugaugaacagaaaacauuuacugaacguguaguuuuguugacugccuucugcuauauccagaacauuuucugguugguagguauucuuaaagaaugugauuuuuagaauauagagugccagcacagagacagacuaauagaaguugagcaucuuuaucugaaauacuugggacuagaaguguuuuggauuuauuuggauuuugagauauacgcauuauaccaguugacaucccacauccagaaaucugaaauccacaaugcccagcgcaccauguuggugcuccaaaguuucagauuuugcagcauuucagauuuuuugauuugggacacucauccuguuuguauaguaauacucaauuuuugaauauguaaguuccuuguuuguguguaucucuguugccuuagcguaaauaacaggaagugaaauugcugggugaaagguaaugaaauuuuuaaaagcuguucuuuuuuuuuguuuguuuguuuuuaugagaacuagacaucccaucagcaguuugugagugcccauuucucugcauucuugcugccacugaauauuuggauuuagaaacagaaaucaaaaugauggcagauuuaugaguggaaaauacuaauucagucagggaacuaucauaauugaaacagugguuguuaguuuuguggcugugguucugguuguguguuuaaaaauucugauuuuuauaacccaacuuuuugggaucauauucucugauuuaacuuaccuuuucucgaucuuuguccccagugcauauugaggcuuauuucuucacauuaauuaauuguuuaaaaagcgucucuuguaugccagauaaaggcuaaugagggauggacagacuguaaaacaugcuuucacucuucauuucauuggccagaugcuacuucguaaaaucagaaguaguugaauuuuucguuuucgcugcuaucaggcuugucaaauuaaauuuaaaaauguaauuuugcuguugaaaucaagaauauaaguucucuuuuccuucccaaguaucccuaugaguuaauucacucaccuguguccauaguguauaaucagcaguguagugauuggauccaaacagauagacuguuucaugggaucaucugagaacacauuaucaaggaugugauacuaggcaauaagcaguuccuuggcagcuauuaauucauguuaagaacuuggaaaagaguaugaggcggauaaaaggcacaggguucuguucacaaugcaguugggaaaagaacagcuuaaaaaaaacagcgcuaagcaaaccaguuuaaaguugcugacuuuaggcaauagauucaauaauuaaauauuaaaaugagauuuguauugaggcagaggguugcauuucaacagagcaggcccagauguugagauuacuauauugauuuaauuaugccaagaugcuuucauugagcccuuggaaaaaagaacacucauucaaaaauugacacauauuuuauucuucauuagcuuaguguugcauacuuacauaauucugguaucucauaaaaacugcaauauagagucugauuuaccaauaaaaugaugaauguggaggaagaaugcaggaaaaaaaucgcuacauguuuucuucagaaugucgggggggggugaaaauucucaaauaauuauggugcacaaacuuucugccuuccugcaccauggggaacucuucuaaaggcagcaguaccaaaugaaugcaucuuuaaucaucuggaaguaagaaauccauuauuuuucuaaaccagacaguaguugucuguuuuaauggaacaguugguugauuacagcucuucaggccuuuauuugcugacugcccauagauauuugaguuccagcuuccaggauugucauaagugagucagaguccaagaauuuagaguaggaaucugagguugaugaauuuacuuugguguagagaguuuaacugagggaaguagauuuccuuauacagauucucacaaccggugugcuuacagcuugcuggcugcuuagagacggacucaucuacaaaugcaaccuaccagauagagcaaagcucaggaccugccaguauucucuuuuuuaguagagagagcaaugcucaccucaguugaagggaauacgagucucuuacagaugucuugacugucuuuuacaguaaccaaauguauguugguuuuauagaaaucagaguuauguuuuaauuguagaauaccauauguagaaagcauuaugcagguugaaaauaaccacugguuaagugcuuugaaaaguuaaaggaaccucugagaugcagucaaaggaaaaguuaaccagagucaaaaaauacugacugcguaauccuuaccuaaggaauauaaucagaaacacuaaagcaaccccaggccacauaugcugguuagaaacucugcugugaauuuuagaaaaucuuagugaagauguuucauuugagauaggaauuuuuaaccuucauauauuuuaugguguuacugaaaaauagagggguuuggcuaaguugcucuuauugugguggugguuuaacguucucuacgguuccguauccuaucagcuauuggacauuuuauuuaaggauauagaaauguuucguuacagcuuauucauucaugaaauguaagacuuauucuuccuuucccugugagaagagccuuugccuuucuggaaugcuuuguuugaucucaguguaaugcccuuggagugcccuuccugucaugaaagaaaggugaggugaaucaaaguaacgccagauaaggcaggaaugugcgcuccugguuacuccugugucacucuggcuuugagacuguggcuguauacuuuaccuuucuugcccaagggauuagcgagggcacuggcugacuuucuucccuuuagauaauguuucaugcacaaaucagacuugccugcuuccuuccugaauucaugacuugguuguggcauaaaaggaguugccgaaauaagaagagaugagcauuuccaguuagucaaaacuaaacagaguagcaaaugaaaaccacgccuccucuguuuaauauguuacgcccuauccagaggugaccguuuuuguuuaaauuuguuaaauuaaaacaauuguuacccuguuuguauuacgugucugaaaguguuucacugugcugcguuaauacuggugggguaaagggaguuuggguuuuuuuuuuuuucccucuuaucccccaaguuagugauuaacauccagucauucacuugugagaggaauguuaguugcuuuagaaaauacaugguaauuauuuaaaguguccuaaagaaaugugguagcuguuucauucuguugaaaacgggccgagcgucaguuccauuuucugugcauggcaguguucgggcggaggcaggugcaucccggggaggagcacaguucaugguccuacgucuccuacgagagccgacaggaaaucugcaagaguaccuucagccccucgcagauacuguccuggcccuucuaaagcauccccuucccaggguccagcacggaagcacuccuauaacugugcagugagaccuucaucugggauuggauauaguuauaauuggagaggagauucagucuagaugagacgauuaaacaacaagagaauguaguuuaauauugucaaauacccauaguucauaaugaccugaguuggcaguuaagacuccuauguaaugaagaauuucuuacagauuuaauacauucuuaaauacaguaaacaagaaaaauccuggcuuauuuuauucaguagguaagcauauguuuauaguucuauuuaaacuguuaauuuacuuauucaauuauuuggauaagugaauuauguaaugccuguguguuggcucgguggauuuaaugaaguagcaaucuuacuguuuuguagcuauugaaaaacagcugaaaaacucaguuuuguuaacuauuacaugcaauguuuugugauuaaaaaaaaauucccucugaaucuuuuuggaaggaucacugagggaauuuaaccacuuuuacauuuuucauagggaucucugauacccaaaaggauuaauaauaacuccagagggagcagaaugaagcucuccauucuggugauccuugauggguccaugaccacagggagaagucguguauuggacuagucuagaacccuaggaggagguuguggggaaaugagagugggagggagaagaguggcaagugugccugcuccaggggccgcaggucagcagcugcaaguccugcuguagguccuggaaggaaaaaggcuuuggagaaaucacgaguggccuuugaaagcaaaacuuucggaaaauuucacagaggcaagauuugagagggugaaagaaggcuugggugaaugcccuuccaugcauucauucaucugguaguugacguuuauugaccgccucuagaaugccagaaccugcucuaggugcccaggacuccacaguuugcaagguagacggugcugugcccuucuuggagcccaggacuccacaguuugcaagguggauggugcugugcccuucuuggagcuauucuucuggagagaggagacacgagucaacacagagaugaggagaaaagaacgcacaguuucagcugagcggugcuguggaggaaaacagggcauguguuaaggauuuuugcagggugugcauggccuccuuagauggaguggucaccugaaugacaagaacgaagagccaacuauuugaagacaauuuuuaaucagagggaauaauagcccugaaacacaagcuuguaugguggaaggucugggaugagguaguuaagguaggugcguggccaggacaugaggcuguggucuguggcugaagggaaugguaggaauaccagggcagucaguccagggccccuuacacgggagugacccugccuuaccacaggagaggacuccguuuuguggcacacacucuuccuuuuuccugcugcugacuguccugcuguccuggagucccaucgcuagguuuuaucccaguccaggcuuucugccugguucccccuuggggcccucagugguguuuguagucacugaugacauggagaaaagaaggaaaauccuccucugaucugccgggcugccucuuuaaguggccauguccugccagacccaguguccucuuugcuaacagacuuucuuuuggauguaaacccuugaaauaagauugcuguuuuaacuacuuuaaaaacaaaucauuaaaaguuguuuucuuucagaagcauguuuuuaguucaaaaagucugucuucaugcauacgcaucauguuagaaacauuuacaacuuucuuuuuuuuuuuuuuuuuugagacagagucucgcucuuucacucaggcuggagugcgguggugugaucuuagcucacugcaaccuccaccucccgaguucaaggaauccuccugccucagccucccgaguagcugggauuacaggcacaugccagcacaccuggcuaauuuuuguauuuuuaguagagaugggguuuccccauguugaccaggcuguucucgaacuccugaccucaggugauccacccgccuuagucucccaaagugcuaggauuacaggcgugagccaccgcgcccggcuaacauuuacaacuuuuagcaauucagaagauaaguaauaauauuuugaaagaaaucuuaggaggugccugauuccuaguccugaaucuggguggcaaccuagguuuucuucccagcuguuagauaaggagaucauccaacgucccuuaucgccuccauaugacaacuaauaauuuuauauauuuggugacuaaacacgaacuauuaugcuuuacuuuuauuuugguaaucaugauaucuucuagcaaugacuucuuuugaacuugguuagucuuuacuuauagauccguaaccaguucugagaaaguaguugugacaaaauguaacgaaaauaaguggggaaagauaguuauggaggcaaagguggacuaauguuccuuucugugucccagaaauuccuaauuugacuuuuccugguuuuuauuguccuuucauguuugaaaugaaacuuugaaacguuuuauaaaaguagcucuucauuuggggcuggagggaaaguuuguggcagaccucacugccacuucagcgguauugaugcauacuguuucagguuaaaaaugcuuuacgcugucaguugaaauaacucaucgaugugucucagugaacaacguugcuguggauucugacuuucuucugugcugcacguauguguguauuucacuuuagagcacugcuaaugccggucccuugucuugauaaggaaugucaccugggcucuacaauaagugauucuaaguucucuuccgaacaccgcuuccaucaucgugugauuucuguuaguagccaguuucugucuugaauaauagcauccuuggaaauacagagguuagggauuaaggugucauaccucuuuaagaaucuucuuaaaucuugguuuugcuuuaguuucucaaacaucaaaauagauucaauagauuaaauaccuuuauuuuuauaguaauucuuauaacccauauaucucccacuuuuaaauaagaggaauaauaaauauugauauaaauaguaaauauagagagguauaauaaauugccaaagucacacauuuauuaaaaugcugaguugggacaguuaacaggcaugcuguaaggaugguugauuauaaggccaauacuuugaaguaacagacugagaauaaaaccuacauucacucuuguuucccucuccaauuccgaaauaauucggugauacucuugaccagugauugagaugugugccuaggucaaagucacugauaccauguuaagguaaggccgauuauuuuuuaagcuuucuuaggguuugguuggcagaucauuaacucugagauaguaucauugacuuuugcuuuuccuaaugugagccauuucccucaccaaucagaaaagccgauuucagucuuaugagauuuguguuaaugcaagcgugcaccucucuacuaggugccacucucgaacguagacugagauuucaagagauuuggguuccaguuauggcuuugauucaagcucugcaaccuaguaacuugugaagucauuuauucccuggacuuccuugucuguaaaauuagaggguugcacuagaugaucuuuacugcucucuuuuaacucuuguucuuugcugauucguugguuugauuauuuaagauaaccaaacaccaugcuuuagaacuuacgguggucuuggagcuuuaugagguaguguucauguaagaggucggcugcccaccacaugugccuuuguaaagguauuugggaguguuuuucuucccuuccagaggggcaggggaggaguggugccugaagagagaaauguuacagaaacggucguguguaauuaaagccuauucaguguuuucacaguggugucaccaacaaugauaaacucagucauagucagauuucauguuuguguuauaugcuauauuacuggaauuuguuaguuuuaucuuauugaagaacauaauaggauggcuuagccuuugcuucucaacacugguaccccuuugcgugucucuuuugaacagauuguguuagucuguugaguuguauuucuuuuuuaaggacaauaauuaaagccagggauaugccagcauuauuucaaaauaggcuuaucaagggagcaucugucaaaugucuucaguauuagguuaaauuaaucgaggcuuuaaauuugcagucguguugggauauuugggauauuucccuguuccaauuagguaaugaaagcauuggaagacacucauggucuucuauuaauggguacaguuagcaguaaacagguuaguuuacugggccugugaauuaugguugauugagaauuuauaaaauuaugaaguaguucuuuagauggcacguuauaaaaaauucuugaguuucagauuuuaacaaauagccugcuacagcaaaccaaccaauguaguaaaauaagugggaaaaaauauacgauugcuucaccaccucuuucauaaauugcugaaugaaaaggcaaucucaauccaagaguuuagcacaaagucauuuuucaaaaaucaucuucuaaacuguagacuugauaacaugcuuuuccuuuugaacccauauaucugauacugucaugagcuggaaauauuugagcuuuaggaauggcaacaguguuguaaguacuaugcuauguuuuuuuuuuucccauguugaauuuguauuuagguuuuggaaaaagcagacaguuuucuaaauaagaugugagauacuuccugcuuauggauagaaaacaaacucaguuuccugaauuagacucucagaacaugcuucugacaccagaugugugggguucccccaacccccauuuuuuuuuuuuuuuuuuuuuuuuuuugagacagagucucacucugucacccaggcuggagugcaguggugcgaucucagcucacugcaagcuccgccucccagguucacgccauucuccugccucagccucccgaguagcugggacuacaggcucccgccaccacgcccggguaauuuuuuuguauuuuuaguguuauuuguuuaguguuaguguuuuuuuguauuuuuaguguuuuuguauuucuguguuugccaggauggucucgaucuccugaccucgugauccacccgccucggccucccauagugcugggauuacaggcgugagccaccgugcccagcccagccuaaauauuuuuuuaaacaaaagguacuuuuacuguuccaaucacugaagaaauuacagggcacauguaauuccuuuuugugacugcccaguauuccaucgaguauguguaccacauuuucuuuaucuagucuaucacugaugggcauuugaauugguuccaugucuuugcuauuguaaauagugcugcaguaaacauauaugugcaugugucuuuauaguagaauaauuaauauuccuuuggguauauaccaaguaaugggauugcugggucaaauuguauuucugguucuagauccuuaaggaaucgccacacugucuuucccaaugguugaacuaauuuacauucccuucaacaguguaaaagcguuccuguuucuccgcagccuugccauuccccuguaauuucuuauaugcaggccuauguauauauauuuauguauguaauauguauauaaaaguaauaauauauuaauaacauauauaauacauaauaucaauaauauacaauaauugauauuaaugacaauauauguaauauauuuacauagcuauacauguauaaaauaaagugauaauagaauauauuugucuauaaugacauuguauaauguucuauuacauuaauuuacaauaauaaauauuuauuuauuauuauauuauaauaaauuaauacaguaggccaggcuggccuccaccuccugggcucaaggauccuacuagauuggccuuacaaagugcugggauuaccagcaugagccacugcgccuagcuauuuauuuauauuuuuaucuucuccgauacguauauuuuaguaaccacccugcuacuuaauuacaacuaguguguuauaaugaacacuuguguguuuuugaauuuguuuuuucuagugguuaguuugaauauaugcuuuucaaauaccaucaacugcuugauaucccugugauguuuauuuucauauucuacaucuucuguuaucacuuuauuuuauuaaugguuaguauuaaagaagaaaaugucacuuuaaaaugaaauguuuauuauuacuuuguuaaagaacagcucucuuaaugaacaacuuugcucucagagaaaguuaaggacagagauaauauaagaacuacugcaguuauucucuauuuuucauuuuuucuuguuucaguucugugcuuuaauuuuuaguaauguagauacaugacaguuauuugagacuugccaaucuauucuuauauagucuuuuaaugucuccagcaagauuugucuucauagucucuaaagugaugaauuagcaguaauccguuuuccuccuguuuuaauucucuuucaaaguacuuuaugagauuuguuuccuguuugcauaaaauagugcauauuaaauacuucauuugucugccccacaguuaccacuaagaaaucuugguuaagauuguucaguuucugagcauauacuggguauuguaggagguuuguugaguuuugauugcuuaccucucaauuuuagaauccugauacauacaggugugcccucuuuugugauuucaaaacauauauaaaauuagaaaucuuccguuauaugauacaccguucuucauuaaaaaaaaaaacccugaauuuagaaaacgggaguuaugggauuaauaugcauuuacaaauugauguuuugccuuaacgaagauucuuagccagguuuaacaucaaaucuugcagugcauuuagauuauuagauagggcuguuugauuuaauaugaagcguuagcauaaaaggacauaucugaaguuucuccuagguuaucaguguccgugaaucacuuccugauuagguuagcuugaccuaacuuaagcuucugaguucuuacagguauugguuuuggcaacaaauuggguauuagaaguagcugaacacugcuuguaaguaguucgucuucaguuugcaauuuuuaaaguuuaaagauuugaauuaaaauuuaagaacugcuuuguaauugaaauaaaauuuaauagaaaaagaaguuucuaaaaauuugauaaaaguggaggcuggaguaaaggaaaaugcuacuugggaauggaugggcaggggggcagcuuauacauacaguccaugaccacagggaccaaaaagucaaugggacuuuuauuugcuucagucagcauucaguucauguaaaacacaccuuccuuuuuguagaacugaauugcauaugauucuuaggguuuauuuugagagcaauaguugcgguuuucuguauuuauaaucuguuuacaggugccuaaacaaaccuuagaaacaggaaaacuggcccuuccaccagcugugugcauucuaggacuccagagacaacugucucuuuggagagaguucuguuuauacagagaccaauguagugcuugacuguaacaggaggaaucucauuccauuccuucuuuagcaagggagugcuuuaaggaguuuggcaugaggcuuagucauuucaacugacauuuuaaucauugaauagugccuugucuucuugcuggaacacacuuugcaguacaagagcuuuaggcaguuguuauucagccuaugaaaaccuguaagucacucuuaacuuuuaaagguugcuuuuacauuucugaaauuccuuaaguucuccuuauaugcuucagauuaacccuuuauacacguugguuuaaaaaauauuuuuauauaauacauguauauuucuucuagaaacauuagaaaauauuaacaggaagaagauaaaauuaacucauccguauaacucgccauuuuucuugcauauccucuucucccuguuuuuuuuuguuuuuuuuuuucacaaaaugaauugacauuuauuuuuuuaaaaucacuuuauuacauguugcauuauaaaauucaagcaggaacucauaacugaagaaaggauuuguuuggucuuuguguaaaagauacuuauacaauaaauggaaaauaauuauuaaaguaccuaguuguuaaaaugcuguuucccuucucaaacaggugcccuucuuuuccucucucucugcugguccaaggaauaaguuacucuuuuauuuaacugucuucucauaggaccucauuuugcucuucuuuuuguuucuuuugcaccuuguagcauaccuggcaugugguaggaacucauucuguguugaaugaauuaaaacagguguaaaucaauaaagccagguuccagauuaagauccaagccaguacaaacaacauuaagucccuuguugaaaaauaagguacagcuuuuaaaaauuaauuguguguguguguguguguguguguguguguguguguguguguuuuagacagggucguguguauguguggguguguguguguuuuagacagggucucacucugucaccugggcuggaaugcagugguguggucaugguucacugcagccucugugauccucccaccucagccuggagcuacaggugugugccaccaugcuuggcaaauuuuuuguauuuuuaguagagacaggguuuugccauguugcccagccuggucuagaacuccugggcucaaguaauccucccacgucagccucccagagugcaaaguggagaaauuacaggcaugagccacuacaucuggcugguuuuucuuucuuuuuuucuuuuuauuuauugcccaggauggagugcgguggcgcaaucucaacucacugcaaccuccgccuccuggguucaagcgauucuccugccucagccuccugaguaacugguacuacagggcacaccaccaugcugaggcuaguuuuuuuuuuuucuuaaugagauuucuuuccuaaagaggguuuuuccuuaaaacguuucuguugaucugccacaaaacuuuuacagcugauuuacacuucagagcucuacaucugccacccaccacucuaguuuuuuuauaguuaauaacaguauucaagacucaguuauaauauucucguaguuagauucaguauuguuaguauaaugccauauaccuacuuacaccuaguauauuucaguuaauuuagccuaugcagguuuuuuguuuuuguuuuuguuuuugagacaaggucucacucuguugcccaggcuugaguacagcagcaugaucucggcucacugcaaccuugaccuaccaggcucaagcgaugccccugccucaggcacccaaguagcugggacuacaggugccugccaccaugcuuggcuaauuuuuguauuuuuuguaaagacgagguuucgccauguuguccaggcuguacucgaacucuugggcucaagugauccacccaccucagccuuccaaaguguugggauuacaggugugaaccacuguaccuggccgccuuuuaauacauaaagaagauaugauaaacacaguaacuuccuaaauagagagcaguguuggauuuuuuuuaauauccuuuuuucuuuuuuauccuaaaugggccuggucacacggaguucuugaacucuauacagggaucuguuuggccuuccuuuaguuguuauaacuuaaguuccaucgcuccucccaccacaggcaagugcugguccaccuugguggauguguugccuguuuuuccacuaacagugauugauugaugagagucagaccuggcuguugaaucacaacucugcaucucauggagauaguacccucugguuuuauguguggacucuggagccagucagccagguuugggguucuggcuucucugcuaccaaaguuggauaacugaggaugacuuccuuaacuuuucaggcuaaguuguuagauguaaagcucuaagaugacuaacugguaagguaauccauuaauucauugguuacuuuauuacggaguaaauaacuucagaccagugacuuuugagccuuaagccucugcuucugaauauggaaaauggggagagaccacugggcuaauugugaagauuaaacaauauggcauauuaaagcuuuuacuaagucugcauccaguccguauaaggggagaagaguaaucaacacugaaauugcguaucuucugaaauuugaaacaaacuuccagaagcauugccauugguagguaaaauauauucucuguaucuuaaugcuucugaaggcugucuuguggauguaguuuuauccaauuaacagguguccagaugauaaguuuugauacccaagggugauccucuuuaacaguagagcuuauccacaaaagccgucauugacaauaucagugauucugacagggaagucagaacuuggaaucauuccucaacaaagcgggacaacaugguuuagcagagcuuacccugggaaugacucuuugcagagcuaaagaaaucccugggcuugaaacaugaugcuuaaaaucugauuauguacuuaauuaauacuacguuuuaguaaguuugcaagucagaaagcuuccucagcuaauuuugaaguuauugcagcaauuuuaauuaaaagaauugauagguauauguuuuaauuaaaaugauuuaaauaggcaaucuaaauaaugcaaacagugacaguuguguuuuugcuuuuccuuuugucauugacuuaugaucucauucugggcaaugugauuauagaauuuccuagaccuaaagcuuuguguaaguaguuaccuacauaaauacuucaguguuaguuaucgaagcugccagaauauccauugucauauaucuacucaaaugaaacagaaauacuuaaaaaugaaaguacaucuaagacauagacagaaaaauaaaacagggagguucuguacauaaaaccuucugauacugggcugcagguauuguuuuaauugacuuuuauuguauacauuuuaaauauagauuuuuaaauccaugguuacagaaauuuacagauuaaaaaaguuucuguucacuggauggauuuaucugcugaucaccuuguuuauuucagaccuuuuuucucugcacauauaauuguguauguguguuuaaaaaauuuuucugaacagcaguagcaucauauuuuauauacuuuuauacguuuauauuuuucucucaauuucuguaucacugacauucuucuguguaauuaauaugcaugucuucuuuuuugaagcuguguauguaccaucauauaauaaguccauuccuuuucccucccgauacaaugaaauucgcuuuagcccagauuuucaaauguugggaaaacggcaucuggcagcuacauuucuggauugcauucaagucacaacuucucuggugaaauuugcagguuguguucaguugccccuuaaucuucccuccaauugaaggacaggcagggacuccaaacauuuagcacgauugucuggaaccugacuuuuaggguugaaucccaguuccccacuaauggacugugugacuucuggcagguugcuuguacugucuguuuccuuucugugaaauaggauaugauaacguuaccuacuucuuaggguugcuguaaggaguaaaugagcugauguauaagaaguucuucucugcuauaucuugaguccauguaugcuguuauguugccaucccugucagucaucaucaggccacugaguuugcucaaaauacaaauggcuucucacaaaauggcacucauggcacaucacugguuuugaaagauugggucaugguggucagugucauggcuucaguuaaacuggagagaaagaaauuauacaugauuuacuguauuuuuaucuguaagggggcagagaggcaccuguacgguacacuaguauacugccuagcaguuugauuggcccacgagggaugcuucuugguugacuuacuuucuuuuacuuauuuugacuuucuuuuauuaucaaaaacauaaaauauuuauagaaguggucucuagcaauuaaaauuuuauuuauuaauauauguauacacacauaauagaacauuguuuuuaaaaguacuagaacuuguuuuuuuccuucuucugcaaaauaaaccauuaaacauuggucuuuacauauuccuuauguuuuaugauuagcaacaccagugaaguaaauaguaauaucuuauaaacuucaggugaaaggaaaguaacaaauguugauuuuaguucugagagcauuuccugugucauucccugagaaaguagacugaauagccauuuuagaaucuuaaaugccuucagcccaauagacuccuccuuuuucauuucuuguucuauuuuaguccacaguaguaaauaacauaaauuugccaacugauggcagaagcaagaacauuaaauguauauuuacacacacacacaccacacacacacacgaucuacuguauuguuucuaaaagaauucaaagguuucgauuuaugagauaauacugcaugucaaacuaguaucguuauuuuuauuuuuauuuuuauuuuuuuuugagacggaguuucgcucuuguugcccaggcugcagugcaaugacacgucuuggcucaccgcaaccuccaccuccuggguucaagugauucuccuaccucagccucccaaguagcugggauuacaggcgccugccaccacgcccagcucauuuuuuguauuuuuaguagagacgggguuucaacauguugggcaggcuggucuuuaacuccugaccucaggugaucugccagccucggccucccaaagugcugggauuacaggcaugagccaccaugcccggcccaguuauuuuaaagaaaggcuaaauugcagaaauuuugcuuuuuauauuaaacucguuuuacagcuuuucuuuguauauaauaggcaaaacaaguaauauuuuuuuauuauuuuacaguaaauuauauuuugaauuagauuguuauuuaaaucuuuagccuuuaacauguaaaguuucuuauacacacauuaggcucucaagguaucaucaagauguggaaauauuaacaucagucuaaaucuaguauuuaaugaaaacgagauuaaaaacagguaaguucaaaaaaguuuuuaauugaaggaaggaaacaaucuacauauuaugagcucucauagacaacuuuuuaaaaaaauaaaacauuugcagaaaaauggagcagaaaguagaaugcucacauaacucccugcucccugccccagcuucucacguuguugacaucuuacaugaguauguaagauguuacaauuaaagaaucaguauugguacauuguuacuaacugaaguccauaauagaugcagauuuucugaguucuuaccuaaggugccuucugugguccaagcucccacaugacauuuaguuacgucucucuggucuccucuugccugcgacuguuucuccuccuuugcuugucuguaauggauaucauuuuuuauaagcacucacuauugacccggccuugaaccaaacacguaacaauucuuuguccuuaaaaaguuugcauucuaauaggaagcuuacaaucuacuuuuaaaauuuaauuuuaaggaagaauugauguuuuuagugauuaacauuuaauaugacaauucugagauguuuagucuuugcauaauuagcaggaaaaauugaauaaccguuuauagauuaauugcagcaacagagauauuggcucucuaguguguugaugguaugucucuucuuuuuccgugaguauuguuuucauauuugggaaaaugcuuauuuucaaaagaguuacccuguuuacgcugaggguauugaauuggagaaaagaguuucugucuguuguugccuguagggaaaauaucguuaaaauuauaucucacauuuaaguuuuucuugugauugaacaaagcagcuuuuaauacaauugcugccuuaagcaguuguaugaaaaguuuaaaacauuaaguaugugacauaucagaaaggaggguagcguuugcaaauuuguguugcuggguuguugcugaugauagguauuucugagagucagaaguaacgaggcuuuguugaaagccuuggcauuaaggcuugauugggggccaagaccuguuaaaauaggaaaauucuaggaggaaagguguucuguggccaugggaauuugaaucaguuaaauuauuuuuggcaaacaucauagcuauaacuuuauuuuugccuuaaagauuacuguguugcaagaguccuguuccaccugugucagcgggagggaaugcuggccuuuccugaucaaggacuauuccuuaacagcagcaggggccagcaguggcggggaguaggaguuauuauuggaaacugugauuuacuuuugaaccguuuauuggagcaacccuauaaccuuugaauaaucaggcuguggaaagacaacgucaguauccguuuaguuaaguaaguggacauuaaugaauccuuccauacagaaauuuugcugugagcucuauuuucaacuaucuugguuaagcucuuuuagaaauuacauuuuucccccuucagucucguucuccacuggaugcauauuuaaagugaguuuccauagugacaucugguggugguuuugaaauccuggagaguauguuuggaaugauaaauauucuuacuuaauaacuccaaauuuccggcuucuuucggauuuuucagguuauuaacaacuucacuguauucucgagguuggaaagcuaggcuuucauuccuuccguaaugcuucauucagguaaagccgugauuucugauggcacugcugaguggcacacguaacaagcgugucucaaccugucuccugugcuccaaaucugcgucauagcaucacgcagcagcaucacgaccgcucucacugcgugugcacggcaaccuccugacgggaguggcgacagaguuucccugucaccccucucacggcucuguugcucccggcaucuggcuggagggaauccugcggaaggccugggcugcagcccucccuccucacagccugggcgcaggcaccuucuggccgcaugcuguguuugcuuucagaaagguagaaggaggggagcgcagaggggaggagaugccgaagacaggagggagaccgcagagaagaguuuggggguggauauacauaggugcccaaaaaggugaggucgugaauauguguaaauagaaagauaccuguaaaaacuauaguuuuuguugguuccuuuugucuccagggugaguuuauaacccacuauauaaaaaaguacuuauugaaaguugauagguagacauucauggauaaagagaaauagacagggauagagguuugagagugaccacaguuugauucacauccagugaugacuggaugucuuuaguuuuauuuuuguuuuucucuguguuaaaggcacuaauuagaagucuucccaauggaaaugugaaaauuuguuucucucuauggaauugagguaacugcuaaaguuacagaagaaaucaaucuguaaucuguaaaugccagucguggcuuuaggaaggacuggugaaagcaugaugaaguguaggaacaagaacugcuaaugacuuaaugaguaaaggcagcuucggucauacuuggagacagcuggugugucacucccugcagaaaccaggacucccuuaaagaaugguuuggaucgugaugaaccccugauuaaggaaguccuucacucuggauucugaacuacaccuguuuagcuucuuggaguuggacaaaucauuucaacguucuuuaagaacaagggaguugcacuggaggguuuugaaggcguucccagucuaaugcuugauuuugagauggcgaaggcuagcucuaccccuggucuuucuuugcacauuaucuagacucucacucagccauccuggaccuucgucuugccucugauucaagaugggaagcuucgggguuuugaccuagagaucucgggcuagugccauagguccacuuuggaaguuucugcccaggguucuugaggaguguaucaugcaacugggcugacagauuaaaaagcggaaaacaaaauaacuuggcacgcuuaaggcuuccuuccacccacuuugugcagugccuauaauagcgccuagguacugaaccccaaaacucugagcggaauccucagaucgucucccgucuguuguccugcaugcaugaggaagacccuuccuuccacacugggaaacuccuuguggccuuuccucaugguuauagccccaccagguccccagcaccuuugguguccgacaguguugcuguugauugauaguggcaacagcccaccgcucaguggagaagacccugaggccuggagucagacuguccggcucagcuccggaucccaccaguuagcuguugacccuggccuuguuuccucaucacuccagggcuuaagcaaguuucuuaauggaucuaagcuucucuuuccucauguguaaagcugggaugaaaaucaugcaacuuccauguucuuucaaugauuuaaugcacauaaagcaucuagugacgugauugguggacaugagggaucugaggauuuugguuagaagauaagauucuucggugugcccuccucucccuuuggcaguugaaauuuacuuuauaguucuccguaaguuguauucagugauuuuuuaucuuacaaagagguaauaauuaaaaugcaucgaagcagaagcuuaucucagcaaucacgauaggcauuauaaaaguacacagucaugaauucaugaaauaggaacauccagcaucucacucauucauacuuacuauuuuaauugcgaauuacacaaucuccgauauuugaauagagucgcuuuguugccucagucuuaaccuuuaguaauauccguagauuaccggggaggccgacaauccccuccugauggacaugacugucccccacccccugguuguacagcugaugggucgguggggaccagcagaugccaucucagaauugcacacugcagucuggacgcuuacggcccgaacuagaaauaaggcacgacggaaaaaucauagcuguuucuaucuguaauugcaaaccucagaugugagggugauauacuuccauuucauaauucuuuuuucccuugagauuagagaaagcuauuguguaugagugaacauuuaauacauuccugcugaauacugacauguagaacagguggaugaaauaggaaguuugacucaucuuucccaaauuaccacauuaaguuuuguuuacucuuuugucauaacagccguaggacugacaaggauauugcuggcgcugaagaugagauuugugguauucacacuccagcucugccauucacuguggcccugggaaagugccucauuucucucaaucugaguuuuucguuagugaaauggaguuaauagcaucacauaucuaggcagguuggauguaaagauuauauaagauaaugcauguaagacacuuaucacagggccuggcauuuaguaaacacugagcaaauuguuucuguaauuaucacuguuuguaaaugccucuagucacauuuagaggggcacauuuuaaaacaguagauggaagcaugaauuguuggaggauuagaacucaaaagagguagauaaaagcaccacguaccugucuucuugagauuuucuaauaauacuucaccugucaagugaauuuuauugcauuuuaaugaaguagcagcacacaggaggaguuguguacauuuuguuaauguguaauccucccggagagaacauucuguuauccccugacgucuuuguaucuguggauagaugugaugaaucagaggaacugggaaagguuauuauuugagccuacagacagauauaauuuugcuaauuuagcagaccaguugagugugugugcauuaugcuuggguuagagaacagggaagcauguuugaguucaucuucaguugucugcuguacggaggaaccaguuagcucauuuuuauuugguucugagguuuauuuuauuuuauuucauuuuuuuuuuuuuacuauccuuuaaguucuaggguacaugugcacaaugugcagguuuguuacauauguauacaugugccauguuggugugcuuuacccauuaacucaucauuuacauuagguauaucuccuaaugcuaucccuccccccuccccccaccccacgacaggccccggugugugauguuccccacccuguguccauguguucucauuguucaauucccaccugugagugagaacaugcaguauuugguuuuuuguccuugcgauaguuugcugagaacgaugguuuccagcuucauccaugucucuacaaaggacaugaacucauccuuuuuuauggcugccuaguauuccaugguguguaggugccacauuuucuuaauccggucuaucacugauggacauuuggguugguuccaagucuuugcuauugugaauagugccgcaauaaaccaaaagcaauggcaacaaaagccaaaauugacaaaugggaucuaauuaaacuaaagagcuucugcacagcaaaagaaacuaccaucagagugaagaggcaaccuacagaaugggagaaaauuuuugccaucuacucaucugaccaagggcuaauauccagaaucuacaaagaacucaaacaaauuuacaagaaaaaaacaaccccaucaaaaaguggcugaaggauaugaacagacacuucucaaaagaagacauuuaugcagccaacagacacaugaaaaaaugcucaucaucacuggccaucagagaaaugcaaaucaaaaccacaaugagauaccaucucacaccaguuagaauggugaucauuaaaaagucaggaaacaacaggugcuggagaggauguggagaaauaggaacacuuuaacacuguuggugggacuguaaacuaguucaaccauuguggaagacaguguggcgauuccucagggaucuagaacuagaaauaccauuugguucugagguuucuuccauguuucuagaagcaguauuauacccccuuucugaagguucaguaugaaauaaugaagcaauaacaaaucauuguaaugcuucugaauggcaauaaagauucauuuuaugauaauuucacauuuuauuuagcuaaguuuucuauuuucaaguugugaguccuuuugggaguauuagauauaauuaucauucauucaaaaaaugaguuuuucugauauuaaccucgaauaaguuaauauuuaauuucgugugaucaaaauuacgaauugcaacaguguauuuuucucaaccaaauguuucauugcugagcauagguaaaauugguaauugguuauuuuucucacaguaguuugcguuuaacgggaaacuucagugauucuagagcuucagcauuuccagaguccagccuguaccaugguguagaagaacacugaaaguaucuuuagucccgagugaucaauccaugagaaaaagugcagugauauguuuuugguagacaaagggcgagauugcaccauugaauaaaaaggugggacuugccaaagagaaauggauauuucuacuucuuauccccagaggagguaaauccuggcuugaaguuaaguuuugacugguuucaguggcuggaccaaaacauuacagauacucuaacccucuucuuuguaaucauauaauuucaucucuugcuaguugacuuacuaagaaauguauccuaguuugggucccaguugaggacuuuucuauaccaacccugauuaagauacuuagauauuucacuuguguauuuaauacguuauugugcuuuguguaaggugcugcggauacugguauuuaagaaugauguggccucugcccuuuuggaguuuauaguguaguuuauauuuuuauagcaugcugguugucuucccauuuguuugaggcgauugaaagaaauaaaaggaccucaacacucaggagaucugagcagccccuuauuguggacuuugaagguugcaguuucuuuccuuagccacugugagaaggggugugugugcagaccgagcuuucuggaggaugcugcuccugccuuuuuccuuagacaguggccgccacagggaugcaguguggggagcgggggugcuggacuguggggucucagaucugggccauggcucugguguugucccugucuuccugaguagccuccaggaaagucagcacgucucucaaccaacuauaaacuuuaccuauggaaaaaugaaguguugggccauuagaugaucucuuagugcucaccuauuuugagacuucagugagauaauauuuuuaaagugcuccauuuagugccugacaccugauucuaauaacaaauacuuuuauagccuauauuaugugccaaguguucuaaucauuauaugcauguuaguugaauauacuauuauugucucuauuuuagaagaaaggaagcugagucacagaaaggcugguuaaccugcucaagguuaugcaccuaguaagagacauauaaagcucucaguaagccguaguuguugacacuuucugaagcuggcaguuuuggucguugaugugcugcuuuacgcuuuucuuuuuucucuguaggugucauagagacgucagaucgacuggaccgugaaucgaccucccauuauuggcuaacagucuuugcaaccgaucagggugucgugccucuuucaucguucauagagaucuacauagagguugaggaugucaaugacaaugcaccacagacaucagagccuguuuauuacccagaaaucauggaaaauucuccuaaagauguaucugugguccagaucgaggcauuugauccagauucgagcucuaaugacaagcucauguacaaaauuacaaguggaaauccacaaggauucuuuucaauacauccuaaaacagguauguguuaauacugcuauaggaaauguuuaugcuuaugcuuuucuguuagggggaaaaguaagaauuagcauuuaucuguuacauacuuuuguuucuugauaaauuguuuuccuuuugaauuauucaaaauaagccuuuauuuuggauaaaaauuuagcauaaccgggcacaguggcucacgccuguaaucccagcacuuugggaggccgaggcaggcagaucacgaggucaggagaucgagaccauccuggcuaacauggugaaaccccaucucuaguaaaaguacaaaaaauuagcugggcgugguggcgggcgccuguagucccagcuacuccagaggcugaggcaggagaauggcgugaacccggggggcggagcuugcagugagccgagauggugccacugcacuccagccugggcgacagagugagacuccaucucaaaaaaaaaaaaauuagcuuaaaugugcuuuuuaaacuuugaguuugcuuuuauaaagcuauuuuacgauuaugcucauuaguaggguuucacuuucagguuaaaaagcaaacauuguuauuucaguaauagcuccuaaauuagugauauaucuuaaacuuacagcaaauucuacugcugcuaagaauuugaauuguccuaagucggcuuuuuguaaagaguauuaaaagaguuuauuucacaguuggcuaguuuuuuaauguuuuaaguguuuccuauagagcagugcuguaucugcaggugguaagggauugggauugaacaguuuucagauuggaagugguuacuuuccugaagugacaccccaggccuuuugcuucuaauauuuuuuuccaucgaugucugugacugacuucccugcuuccaagaagauagcuccaugaccucaaaauccuccuccgaaauuuuuauaaacuucuaaucuuuguuccuuuacugcacaaguggugacugcguucacccuccuugugaaauaaagcaaaagugagcuaagaacuaaguacugaaaaauuaaaggcauugucaaacauaagagaaaagucagagguauauaagaauugugaggaugaauuuggaguccagaauguauguaugccucucuaguggcggucccagaccuccagagagagaaaucuagaaguaaaagccuugauugacacaaugugagugugaacaaaaacccucaaagagauguuuuccuacccucuucccaaaccucaacaaucaucaucacagaagacuucugggaccaaguguguguuuggggggcuggccggggggcgggggggaggauuuccuacacaccaagcagcggacaccuugggaguccucucauucaauucugacauuuuuuuaccuggagacagccucagauucugcagguuaagggcucaguucccaagaguguucacuucuucccaccaguugcaagccgaggccucugaaacuccugacggaccagcuccaagcgaggguucccauaaccucucuucaagcccaggccuccgaaacuccugacccaccagcuccaagugacgguucccaugaccucucuuuggguucuguuacuuuauuggagcggcucacagaacccagggaaacacuuaacauuuaccuguuuauuacagaggauauuuuaaaggaugcaaauaaacagccagaugaagagauacacaggggcaaagucugcaagggucccacgcacaggcauuucugucccgguagagucaggguguaccacccucccggcaccuggaugaguucuuguucaccuucccguagccuccacguguucagcggugagaaacucugaacucugcuuucuugggccuuuuauggagacuucauugccuaggcaugauugacgcacggacagccaugucaacaugugguugacaaaggccugucucuugagauuguucuuggccucugucugcagcguuuccgccuccaggauauggagcgggacccucucuggaaugaggggcuuaugacacacagucagauuggaguccugccuuggcaggugaaaggagaguggcagguggcccggagagagauucuguuuccugaggcaaaaagugccacaacauuauaaccaaagacuaacagggguucugggaguuaacgagccaggaaccauggacagaaacaaauauguaccccuccccacaacacacguauaugucauaucucagguggcaauucaagaccagaacuaccccuauaguaauuuguuugaugaauuagacuaagcaguguuuucaauuuucuugugucuucugucucucuuuuagauuagaguaaguccucugugaagagauagaugagcaagcaagaaauauccuuugggauaucugagcacauggcauaggucugggcauaauauauguuugaggaguaggaggagaaagaaacugaggagauuauauagcuuagcauugcuguggggagccuugaaaacccuugguucuuccugggaccccagaaaugaugaugugucugcuaugguguuaugucuuguuguagaaacaugauuaauauggcauugccucucccuuuuaaaucucucuauucugacaacucuaaagaaaagguguuugcagagaugucugugcuguugucuucagaaggaauaaacccucuccagguguccacagccacaccccagccccggcgggagcacaggcacuccgcuggcagggcggcaggaggaaauucagugcaaugcacacagaggcuuucuuuccuuaugaguugaagucagguaauaguggaggauaccauaguuaguacacagcaguauuuguugugaaguauguuaaaaacucugugguuaguaaagaagucucaacauuccacagaucaccuaaagucucugaagaugaagaacaguauuuuagcauggaauuauuaaauaauauaguaaauauagcuucauuagaucuguuucuagaugcuucucuucccccaccucagcagaaaguuggggugugauccucagggccugaaguacacaugccucgucuucuuacaaccuuuaaagcagacuguucccagguaggucaguaucauggcggccugauugugaaggcugaugaaaguccguccgguaggaaauagugcuugggagucacugacccaucucgccaccuggagacccuaaaucguguuacuuaaugauuaacggcugagcaaggaaaucacugggcuggaaauccagagauccggaccauagugaggccuucccucugggaucuuggggcgaacugacuuccagguccuucgauuuugugauucaugguguuucuguccccuguugaggcucguguguguagagugcaggagcgcccagcgucguucaggggacaggugccacagccggcuuguguguguagagugcaggagcacccagggucguucaggggacaggugccacagccggcuuguguguguagagugcaggagcacccagggucguucaggggacaggugccacagccggauuguguguguaaagugcaggagcacccaggguuguucaggggacaggugccacagccggcuuguguguguagagugcaggagcgcccagcgucguucaggggacaggugccacagccggcuuguguguguagagugcaggagcgcccaggguuguucaggggacaagugccacagcgggcuuguguguguagagugcaggagcgcccagcgucguucaggggacaggugccacagccgcuuccucuugcggguguuacgguugcucuguuaaugaaugucagacaaucaagaaucuaguagacugauaaacuugugccuuuggauaaacacauuugcuagaauaaagugggcccacuuguuucuuagaaacaugaauuugggacccuggugauuauccuaaacguccagcagcuagagaauaccuacaguuaucaucauuuaaagcauuuguuuaugcaucaaguacagucaugggaggcugaaugccagggaugcauuuugagaaacgugucaucaggcgauuuugucguuguguggacaacguagaguguacuuacccaaaccuagauggucuagccuacuacacacccaggcuguaugggauggucuauucuagucuauagaccuguaugccgugauccuguaccgaacacugcaggcaguuguaacacauuuguguauccaaacauagcuaaauguagaaaaggugcaguaaaaaugugguauuaaucuuucacaaccacggucguaugugcgguucgaucguauaugcagcccgugguuaacugacacgucguuaugcagugcguggccguguuuauuuaccgaacuaugaaauuuuuuuaccaaaucuuugaaaguucgucaucuacaaaagugaaauaaccaagaagaacagaugugugcagcaguguggcacaggcucucacggguccgguggaggcguggcaggggcccucacggguccgguggaagugggaaacuggcagugguuauguugggaagaugagccccuuggaacggguacugggcugauugugaagaugguaacaauagauugauggagaggagguaggagauguuuucaugucggcgacaauuugaaggaauggugaguuggagaccaagaaauaaguguaugggagacggcuacccucaguggaaaaccucgaaugccagaauaaggguuaaagagaauauuuguuauuuuuauuaauaaaagugaccucuuuuugagucaguauaaacugccuugcaacauuuuggauaaacuuaaauaaaagucuuuuuggaaaagagggagacaucuccucaauaucuuuuucuccuuccccuuuugucauaguguaacaaaauauuuuaaaagucacaacaagaaagcuuucuaggaguggguuuagugagugagcuuaugaauuuuguguucuaaaccacaaguuugagugaacuuuuuugaauguuuuuucucuucaagguuuuugugcuuaauuauggugccaagaacugucugucugcauuucagacauucuuauuauauuguuugcaaguaggggggcaguggguuuucauuuuuaggagauacaagugaaagaccgcauccauucucuuuuugugauauaugcacuuuuguugacauugcuaauuuuuauaacauuuuuuguuugacuguguccaucaucaguuacaggguaaaugugcuucuuuuaacuuaaguugagcacuugcucaagguggaagagagacaggagcauagaacucagauuggagccuuggcagcugcagcgccugcaaacaaaagcaucacagcuuuguggugugucaaggacagagaagaaagggagucccaaacaaaagagacuagugugagcuucucaugacucauuauucacgaacaaccucgggaaaucgacaccacccuugcaaagagucuuuuuaguuaaaguuauugcuuugaacuugggggaguugauaugcaacuuacaauuggcauuuauuaauaauuuugaaguguuacuuuuagacauguguguccuuuagaagagaccauggucuugcucucuuaucuguauguuugauauuuuucacguuuuugcuacaaaccaaguauugaucuuuauuuuuaaaaagcuuuuuugagguguaauucacuuacagcaaauugcacauauuuaaagucuacaauuugauaagcuuucacauagcuuuuacaccugagaaaacaucaccacuaucaggcagugaccacacccaucauucccaaaggucuccucacacuucucuguauucccccucccaacccucccaccuccaucucuagucaaaugcuggugugcuuucuagcacuaaauaauaguuugcauuuccuggaauuuuaucuuggugaacucacauggcauauacucuuuuugguaaggcuucuuauacuucgcauguuuauuuugagacucaugcauguuuuggcguguaucaagacuacguuucuuuucauugcuguguauccuuuauauagauagauuaauauuauaauuuguuuauccacucaccuaguaauaggcauuuguauugcugccaguuuuuggcaguuuguaaauccgcugugaacauugaguacaagccuuucuguggacacauacuuccauuucucuuggacaucacauaggggugcauagcugucuggaaacugucucaaggcagaaagcugcugcgaucguggguguccccucaucuguuucucucagggauccuugucuuucuuugccugaugucuaguguccuuucaacugccagugcauucauuuugucugcuucuuggugguuuuauguuaaagcauaaaucugaucccuuacuagaaguggaaggucagcuauugcuuuuaaaucagaaaaagaugccuuuuuaaguuuagaagugccaucaauauguauguacuguaaacaccuccuuuaauaaacagugaaucuucuuaaccaggguuucugugucuuggaguaaaaacugaauuucuagguuuauuuuaaaucgaaacuuagcaauauccugguuauguuucuggaguuuguggaaauacagauauguaugcacuuuuugucccucccaaauugugcuguuguguuguacccaguagccggaauggcacuucucaguccuccuuccccagguaccauucaucaucaguuuacccugcucagcaaggccggaaggcagauguguguuugugacguguguuugugauguauguguauguguggguagcacaccucauaaauucuaucacuuguuuuaaauggguaaugcaaucacauggcacaacgugcaaauaguacaggaagauacccagucagguuuuacuuucacccaguucuccagacacuccguucccuuccuuaguauauuaacucucuuuucuuauuuucuguauccugaaugcuguggcaucugggcccucauugaguggggaaggacugccccuuccaggacucgggauagcagaugacuggugcaggaccgugcuuuucauaugcaagcugaccaguccagagucccacuccacaccaccaucugugucacgcccaagucauaucagagccagugcuagacaacuggggacagcuaugccccagagccuuugaaauuacuuaaaccagccaguccugagcgucucaccuugccuuucugugagauccucagucaagcuuucccgguuccuuccaccuccagaccaacccuggcauggucccguauggcccagcacggccuucggccuuugccaccuucaguggcggugguauggccuccucuuggggaaguaccaaacugccuuugcagguacuuucagguacuggcggucguaccugaucuguugccucaccauaccugaauaauaaaaucuacuuagaggcaacuaguguuugcauuuucuuucacuuguauauaagcaagaaagaauauguugguuuuuuccucaucuuuuuauacagauagcauacuguauacauggauaugcaucuuggguuuuuccauaacaguauuggaugcugugcuuuuaagagcaccuuggcugggugugguggcucgugccuguaaucccagcacuucgggaggcugaggcuuguggaucacuugaggucaggaguucgagaccagcuuggccaacauggcaaaaccccaugucugcuaaaaacaaaaauuagcugggugugguggugcacaccuguaaucccagcuacuugggaggcugaggcaugagaauagcuugaacccaggaggcagagguugcagcgagccgagaucacuccacugcacuccaaccuaggcaacagugagauugcaucucaaaaaaaaaaaaaaucaccuuauugugguuacugaugaacuugccacauuauuauaggaauauaugugcauauccauguaccuuucacuguccauuucacuggucuacugauuuuaucuaaccaauguuuacuuuuuaccucuucucauucaucuuccucuuugagaacaaauacaguaagaaagaaauuuauuuaugacuaaaaauaaauuuaucagaaaaguuuaguaguuaaugguacagggcauccucuuugacuauauauguauguuugugauuucugugugucuauauuugcaucuuaaaagguuuuaggcucuuugacagcugcuaccuguauuucugucuuccugagauuuuaaauacauaaugcaaucacauaguacacaauucaauauguauauaccauaaaaaccucauuugauaaauagugaaucuucuuaauggagguuuuguguuuugaguuuguuucagcuuaauguuucuuagguuuuccuuccuccauccuguagagugaaguuuuuuuuguuuuuuuuuuuguuuuucgagacaguguaucacucugucguccaggcuggagugcagagaugccaucuuggcucacugcagccucaaacuccucugcccaaguucuuccuuccucggucuccugaauagcugggaucacagaccugcaccaccacgaccagcuaguuuuuauauuuuuuguagaggcaggggucucaccguguugcucaggcuggucuccaacuucugaucucaaacaauccucccaucuuggccucccaaagugggauuuuuauaggcaugagccacugcgcccaaccuguagaguaaaaauuucauguauuuuggagagugauccuuacucaaaaucccaucucauuauuguggagcacauugcacuguuagaaucuugcugguccugcugguccaucagcugucucaugccuguucccuuggagagcugagcuugaaggagauagcccaagggaaaccagcaaagccuaauuuuccuuguuuugccccuuucugucucauucucugaagucuuuuuuuauaccacucuuccacccgucuacugugucuugccaucacuuuuggauagggcuggaacagaacuuucguuaggagucagaggaacauugacaagugugucucaucuauuacgagcagcuuccacagacuucaucuuuacaagagcccugugagauggugacuacagauaccaauagccugcugugcuccuuauuuacauuuucuucauuuuacaaauaaucuaagacuucacagaggucagagcuaccagaggucaggcaaugugaauuuccuggcugccgcuucucagugcauggugccacucccagucccugugccuuugcauuuggguguaaaugugguuguggagccaguuuuucugucucuuaucuacucuuugcauugagggacucuguuucauauaauaguugcuuuucaggcuaaucuuauuccuauggugccaucagaccaaaaaugggaaacuuuuaaguaacacuagauuuuuaaacuuaguuuuaugaagcauguaccgcaggggucaucaaacuguuucuauaaagggccacacggggcuuuuggguuugugggccauacagucucugucacaccacucagccgugucacuguagcccagaagcugcuguagaugauacggaaaugagugagcaccgcuguguuccaguaaaacuuuguaaauaaacgaaauaaauucaauaaaauuugaauuuucugcccuuuucauguaucacaaaaguuuuuuucaaccauuuaaaaaugcaaaagccauucuucacuagccagccacacaaaaacaagcuacugugcuuuccugacuccugaugaguggacguauuuacuggugggacuaguuaaacaauuucguugauugcugauuuuuaaaauuauuuugaagggauagacuuuuauauuucugaaguaaaaauugaaucccucccguugcucuaagcaagagugcuuagaaaggauguuuguauuucacuucucuugguuguuaauaacaaaauuauucuuuaaauagagcaauuagaguaucaguaucaagguugagaucucagauacgauuuugcaaguugguuaguagacuguuagaucucuucuacauugggaaguaauuguuucucauuagaagauaaauuuuccuagauuuugagguuuuccuacuuuuucuguguugauguguccuguuaaguuuucagagcucccaauuucagcucaaacaguuggcucuaaguauacuuagcaggucuuuaucaucucccccauuuuguuuauucucuuauucugugucgacauguuauacucaaauuacucaguuuccauuucauaugcuuuuuagaggacggcguuauacaguguucuguuuuuuauucgcuucuuuacauguaaaauccuguauuuaguauagaauuauuuuauguuuacuauaggaaaugugauuugugauugcagacugggcagcgauguauaguuuaugugugguaaucccuaaagcacgcaguaaaguuacaaaaugguagaauagcugguagguauacugggugcucaucauguguuaguccaguaacacuuuacaacuauuuuuuucugaaccagaguaaauggcauuuuauuguggcuggaacgaauacugaacaaacugcaauaggaaauagcuaaagcugcaaacaacuuccagggguuuccgguaacauuugauagcugcaaaggaaggaaaggacgggccagucgcauuucaauggcaggaauucauuuaaaaaaaaauuaccuauuugcagucuuuuuaccaagauacgcagauauuuuaaggaggaaucuguagauuuuuuuccuaucucuuucucaugcucauuauuauuuuauaaaauaagugaaguauaucaucccuaaaguuugcaagaagucaaauguuauucaguacauuucugccgauguugaugaugacaaacuuuuuccuccgcaaauugguuaacuugaaucuuugugauaaauucugucagcauuugguuuuucuauagcugcugaauauuauuugcuaaaauuauaguuaagauuuugcauuugggugccugagauuagucuuuuuaugucaacaugauguuaaccuuauaaaauggguuguguacccuauccucuucuucugacccugcuauaucugacauuuauaggaucacugaaggcaauucccuguaaauugaguuuugcugucgaucuuauguuuuaaugccaucaauuuucaacaagaaacagcuaguaagguagaauugaaagcagaagagacgucugaagacuaggguauggggucccuguaugacuccccaugugacuuuagacuagucguuugauccauuuuauuaguguuuucuuuggaacucugaaaguuugaacuaaaugaguucugagcugcuuuccagccucgccagucuaugaauagaauuccauuuuuggcuccacgccuaauccugccggcaccaguacuucagggacaaacaauagcugcugagacggccacagcugccgaaagagcgcgcagccggcuguagugacguguggucuuaggacaccaccugaguaaagacggugcggugcugcggagaucuccgagcucacaguccagagcucugaggggcugggugcugagugauaaagugaaggagaagcugcguguuugcucguggccagcaaggcaaucuguguuuugcagaagcggaggacgugacgccucccugccgguggacuagucggcuugucggcucugcauguucaguguuggcucugguguguguuucggggggauccaguguuggcucagguccuuaugggccaggaccaccuucauucauuauuguauccaccacagaaccaggcgugauacucaugaaagauuuuuaaaagcagccacauuugaaggauuuucccuuucacccauuggaagaggaggcauagcaguucacacagacaaaugcugcccuugauguaguuucugucacucccgcucacuugcgccuucuguccacccauuguacagcucucaggacugugccaugaucucuaagucacauacacagcuuuguucuggggccguuucauuuuauuuaagcugguuggguacagauccguagacuagaauguuccauggaugacauguuuacaaagggacagucaggugcuaucuggaguuccacaguuacagucuguuauuucuguagcucauggugcuuuauuaauuuauuauuaauaaauuuauuauuaauaaauaaauuuaguaauuauuuguuaauuauuaauuuaugaauaauaaugaagcaucaaauaauuuaucaauuauuaauaauaaauaaauuauuuaauaauaguaaauaaauuauuuaauuauuuaauacuucauuguaaaaaucaaaauaaugaccaauuguguugcccucucuuuuccgugcaguugguugacccuggaccagugguguugcccucucuguuuuccaugcaucugguuggucccuguaguucuuugguagcuuaccuaacucagagcaagcucucuuucaacacugaaccauggacauuuaaaacaauuuuuaggagcccaagauuuguaacacauguccuguaaaguucuaaagcacuuuuacuuaaaucucugaccucucauaucuucccuauuuauguaauuuauguucauuuuuccugguauuaggccuuuuuacuguucuuucuuagcugcuguauaagagaagcaagagguacgguuaaaaucgaaaggacaguuuggguaaacacagggugagcacagguaaguuuuucugacuaaugauaacauuaggcaaauuaguuuuguaaaaaaaauuuugauuaacuuauuguacccugaggcccauguugcuggugaagugaacucuugaggacagagaggcuauuuugcuuuacucagaaucaaagagucuguucugucuugguccuuaguugaaacagcuuuagaguuggaacuuuuguguguuacaggcaugaagcuagaauguauaauuauuaauagaguuacuaagucaauauuuagggaguuuuuuuucuguuauggagaggaaagaauaugagaaauaauauacucagaacugauguauaauuugugucauauuuuguauauucauaacugaaaacaaaagacuuagcugaguugugguucucagccagagauguuaaggaagucccauuccagagccgaggcauccugcucucuccuccuccugagggaaagcaugacuccacuugggaauuuuguuucaucccagaucaccuuuggagcugaguuacuuguuuaauccucugcuuuuugucucguguguagagugauaagccuaccaagccauaaaacauuucaagugaagacacuaacaaaauacagaagguaauaaaagugguuaucucugaauaauggaauuguucaccaguguuacccaauucuuuuagaaaauauuuuuucaguacuuucauuugcuauccaaauaaaaagguguauuaguauguauauccagacucaucagauuguauauguuaaacauauguaguuuuugguauaucaguuauaccucaauaaagccauuaauuuuuuuaaaaaagguuuauuucccuaaggcuacuuuccauaaauuuaaacgacagagguggauucugucgcgguucuggaggccaggaguuugaauuccaggugccgugagggccuggcucccucugaaagcgcuaaggaaggaccuauccucgcuccucccagucuccaggaaccugcuggcuugugacggaaccacuccagucucugcaucugucaucagacaccuuucuucccugggucucugacucaaaucuccucuaccuuucucuuaaaaagacucuugcuauugaauuuaggguccaccauaaauccaagguggucucaucuugagguucuuaauuacaucuucagggaugcuuauccacaucaguucacacucacagcuuccaggguuguauguaucuuuugggcaggagccaccauucaauccaccacaaagguauuuccaagaagacggaaaauaugcuguucaauggaaauguauauagccauuuagauuccucuuaauuuuuuuaauguuguaaagacuacauuucauuuaacuuuuguucuaacaggcuuuaaugauuuggucgguaguugcagacuugucaggaagauucugggugauguuuuaggacuuaauaagcaguugaagaacagauggaaucuucaggugggcucucccggccacuucuuuguugcauuuuuugcaauguuaauuaugcuucuuaugguacuuaagaaccauacuugagaaauacuguguauuucuuauauguccauaguccuauuguguuucucuguaucucaaauaguauuuuaaagaaauagauaauaugcuuuguuccagaauauguccaguaguaauuauuauaaugacugaaaacaaaacuguuaaaaaaagagugaauuuuuuucaacuucugucagcaccuguacugaggaggucagcaugggauggaaucaccgggaaaccuucaugagaugguacaggcuggguccucaugaguggagagugugauuugguggcucuggcauggagcgggaagaagggggguuggcauucacaccccaugaucccgaugcacaccucugcaggaaaaggcucgagcaguagagccuucugaacacuuuccuugguaggaaaguuucuccugcugacucagaccuucaggaaauuauuccacaugccuagaccucauuuccucauguuuuaagguacaggauuugggcuagagcaucgugaaagacccucuggcuuuagcaaacuuuauuuuuacaguaagaggauacuuagcacccgugauccauuucauuaaaaauuugcugcaacucaaaaacauuagaaaaagucauauaggauaugccacuucaauauuucuaaggaguuugaguuuuuuauauguguggccauauauuaguguauauaaggcuuaaaaaauaauugauuugagauuuuccagccuaaguuuaguuuucagccaucaaauaugucuauauuuucacucugagcuuuaaaauguuuuaauauuuaaauuuauuugaguaauaugcccauuaaagauuaaagauggccacaauaaaguaguguauaaaaugaaguucuccugucuccucucuucccuccucucuccucucuucccuccagcuaccuguuccauuucccaggaguagccagaaguaauaugucaggguugaacgugucacagcuucugugcacaggaguuugugcacacauuacauccguacacacauaugcaugucucaucagccccuugccuugcugguuuuuguagugcuccuugucuaaaaguuacccaaacaguguaaguuucacaguccgcccaugaguguauuacagguguuuuauuguaauuguccuuaauguugcugauucuuaagcacacugaaugucccugggagcagucccugccacagucaggauugaaggguagaaaucuaacuuccggauccugguaguaacaacuccugaagaaauuacacugaagacccuaaaacuuaaacuagacacuuccuuuaccaccaaaaauacuaugauuacaguucuuaaacuuaguaucaaguagaauauaugaaaguguuucagagacaucaucgggugaaaaugguauguaucugaagugcgugccugcagucaaggguuugucagaauaaugcuaugauuaauacaacaucgugagaaagggauggagcccagaggacuccuuccugcaaaaggagcugggcuugguggagagaacauucuaauccuagaagaaagugagaucacugaauaauuuuguuguauaaucauuauacauauuaaauaugauugauacauuuagaguugucuaugugaauuaagagcuuggacucuggaaucagacagacuuggggucaaaucucagcuuugcauuuagcuggcaaugauuuuacuucucuaaaccucagauaucuuaaaaauaaagguaguguguauugguagcucccuucuaggguugcugugaguauccagugagagugacgcauauaaaaugccuaccccagagcugggucuugggaaacacauaauuagugguggcuaaaaagcgaacugugagaggacaguuuaauauucaccucugccuuuuacaugugguaguuguuuccuuaaauaaauuguaugccuuugaggacaagagccuugucuuaggcuuucguauaugucucucauggugacauuugggaacagcauucugagcaguugaaugacagugcacagugaacaagugggugacugagaucguaaacauuaugacauuacuacuguuuaugaacauagauuuaauuuagucacuuuuagugcuuaggaaaaagaagcaaaaacaaaacaaauuaguagagucaugauucuccaagucacagcuaagcacagagccucuugauugguacguguucaggugaaguaguacaccagcaauucuaaagcaggccucuucgucgcccgcugagccaaguggagacucauagcagagaacggggagcaggagcauggcagggcaguaucagcacagucaaaaucuaggaaaguuuuacuuuuuuuuuuuuuuucuauguagguuuaagacagaugucuacaaaaauuuggauuuagauaaauauuuuuugcuucaaauuuuaaccacagaaaaggauuuugaauauugcagauguuaaaguuuuuaguuuugacaggcagcauuugaaauuggagaugcuauaaaggaucagacauaauuggugacuauuuaaauuuaaauuauuuaaauuuaaaauucaguucuauggugacauuagcucuguuucaagugcauaguggccacauguggccaggugcuaccauauuggacagugcaaauuauagaacacacaaaucaucacagaaauuucuguuggacagugcuuuucuagaacguguauggcugugguucaugaauuauuguaaaauaaaagggcggaaaggccaaaaucauugcaggggguagaggaaaauaaucagaguaaaaggaagguaucgggugaccagauuuuuaccuuuuuuccuugaucuuuuucccuuccugugcuuauucucuaguagaguaauugaaaaguguuccaaguaaauuuccugccgggugaggugaacauagggcugcagagauuccuuccuuuagagccaggacccugucuuucaguguggggucaucgaugacucguacuacagauugcaagugcuugcucucuuguugcaguuggaccugaauccuauucagaaauccuauuuuuuuccuuuucuagcugccaucuuucauguguguguguguguguguguguguguguguguguguauauauuuuuuuuuuuuuuuuuugugagacagucucacucuguaaccuaagcucaauugcagugguccgcccucagcucacugcaaccucggcuucccagguccaagugagucucaugccuuagccucccaaguagcugggauuacaggugcacgccaccacacccagcuaauuuuugaauuuuuaguagagaugggguuucuccauguugaccaagcuggucucgaacuccuagccucaagugauucaccugccuuggccucccagagugcugggauuaugccauccauuuuuauccacugugcugauguugaaauuuauuuuuuacagaaccacagucuucagucccucccugguuucuuucacuuuuaauguagacuuacuagauuuauugaacccccaacuucaauacuuugcuaaaugacguugaguaagcaacuuaaucucucuaagccuguaaaaauggagauaucuucacauauuuacacaucauaugugaagauauacacauauacauauguggauauaucucaguuuuuuacaggcauauauauauauauauauauauauauauauauauauauauauauauauauauauauguaaugaaguaucuauuaaagcauaauaccuuggcuaacaaacugucaaaauugaguggcuugaaauagcugucauaauuuaguuuaggguucugcugggcaguucuuccgcccuugaaauaacucauaauuuaggguucugccgggugcuucuuccacucuugugcaggcuuggcugguggccagcugguccucgguggccucacucacaugucaggcaaugguggagcagcacgaaugacuagaccacgugucuucucuuccaaccaaguccacacuuuucuggaacacagaguugcuggcaagagccuuccuccugcuuccuguuuucuguguguagcuccugcacuguguuuucugucagugcccuacaaucuauccugucuuacuguuucucacauguaaaguagucuuugccaacuucuagccuucauccugguuucuugcaaacaagacugucuuaucuccacuuucugaguggacaguacaacacaguugacugaaugcauucaucgcuccagcuguguggaccaugucacaugacugucuucaccuacuaguccuuugauguucacuuuuacgucuaucugcuucgcgaagucuacuuuaucucuugaauuuugagaaguuuggagaugguuuuguuacugauuuauaagaaaugucaaagagcacaauuuuauauugaaacauagcugaucugacauucucucuguucuaaaugaacucaucucuaaaugucuaaguggcguugaaaggccaugagugguuuuuaaugauguuccucaagugccauaaacuuuguuacugcauugugcauacauuucuggggugaacugguaacugcucauuggugagaauauacugugucugcugucucagcccaccuacauuuaucauaguuuuauuauauagaaugcaguguuuuucuggaccaaggaaagaaaaauuucuaguuuuucuuccuuucuauuuuuaauuaucagugcuuggcagaagaggaagaugaaacacaaaguuacaaaaagaaaacaguugcauauacguuuuucugcuuuugccucuuuuaucuccuaacuugcuuuuuuggaucuauuaaaugacuaaugaugagucauuccugguuuuuucguuacaguuuaugaaagucacaguucagaguucauggaguguugaaauacuauaauacagcaaauuacgcagucaggugugauagggagaaaaaaacgcucaucugagccucaagagaacgaaauccuacuccuggcuuuguuaaugacuuacuaguggccuuggaaaauuuuaacuucucuuugguucaggcagcucaacuugauaaucuuaaagguuucugucuaguucugaaguucuguacaguuuccuuuaaguauauaucuuucugggauuuggcaaaaaauauugcagaugagcacagaugucgaaaaugaaagaaguggacauacuuacuaggacacuuacuaccuacuagguuaauaacauguaguggguauauggagcaguuguacuuuagaauuauguuugaagucgauguuucaagugggugggggugggggggggaugaggagcaggagugaugcucacagaggcgugaaugagugugaacacagaacacacucgguagauugucuuguauggccagagugcaggggguucggguagcguuccccgggguguuaggcacucagugugguugauugcuguaagguaaagcgcaccucgaaaagacacccagaaugccuaguauuaaauuacaucauuaggaaauucuguuuucauuuuguaugaaaaucccacaggaagcccuaauuuuacuguaauuuuucgcagagggggugcaucaccuggugccacccccauaggacacucaugcacggccucucucuggagauggcauuagggaaaagcacuacggcagccuugcuaagauucuuuuugcuaaguguugugaauuuagaaagaaaguuuguuguuguuauuuguuuguuuuugucagucugaaauaucuuacguguucuccgcagaaaaguaaacccacccugcaggguuucuugcaggaucuugauuugugaauuaugccuccugaguagaccggugccguccagcagagcuuccugccguggggagcgcguucuccaucugccuugcuccaugcugucgucaccggccccugggggcugccguacccuggaaauuuggcuuagugugauugagaaacugaaguguaaacuuuacugaauuuuaauuaauuuaaauuccacuggucucaggaggcuaguggugacuguauuuguuaguggaagucuacaucuucgucuucucucuaguuuacaguuacaugugagacaaucucgucuucguaaaaguaauacuucuccuggucuacuuccugccucacuuucucuuuucuuccaggcuccuccaaaguacguccuccuuaaaaucgucugccuuuggcuucugggacacgaagcuucucuuccagcagauugcuuccuagguugaagaucggcccgcuauuuucucuaccguuuuuauaggcccacuguucucuuuaguauuaugcucacuucuguggguguggucugagucacaccugucuguaugcccacagcuucuucccugcgccucgggucugugcuucuaaauacccgcagggugccgccagccccuagccacccaucgcagcacguagccacccauugcagcaccuagccacccaucgcagcaccuggcacacgcugccuauaaauauguacuaacgcauucucuguuggcucacuuaugggcuguggauuuguaucauuuucagguuuacaguaguuuaucucucucacucuagcacauauuuuuaauucugcucauucauaguuuuaagaaauucacauguucacacguuuaaguguuucuugaggaugacggagagauagcuaugugagcaagcuaugcaagaaagacagccacuguccucgugaguuuuccaguacagaaaagaagacuaauuuuuaaaugaggggcuuuaauacuguggaguaauauuaugauagaagaaauauuagaacuuggagaaugcagcagcaggaacccacgccaggcccugcagugaguuuaaaaguuuaaacccgcuucaguuuaaacugaagggugaggcagugacucaggcugaaguggaaagaaaggggcuaauauuaccauucauugcauugggaugaaauuaaagcuccaucugaguuaacggaggagaauuaauuugaggaguauagaacaugcaaauaauuucagacccaggaaggagguggucagguagccuuuuggcuuuauguggauuuuguuuuuuuuuuuuugacagaguuuugcucugucgcccaggcuggagugcuguggcgcaaucucggcucacuguggccuccucuucccagguucaagcuuuucuucugccucagccuccugaguagcugggauuacaggugugugccaccaugucagcuaacuuuuuguauuuuugguagagacaggguuucgccauguuggccaggcuggucucgaaccucugagcucaggugauccgccugccucagccucccaaagugcugggauuacaggugugagccaccaugcccagccuuuuuauguggaauugguaguauggacacagguacagcuuuccuuagccuucuugugugcucuaaguaaaucgugaaguggggaguuguauuugcucauaaguauuugcgcagugcuguuggugagugauuaagugcucugcagaagaauacuguuuuccugggaacgugucaagcugcuauuccacgugauguuaccaucaaucacaacuucuugguggacacauuacaauaauuagaugugggacuaaucaaggggcuccuugucguuccugaacuauuuacaaccacaguuaggagaggaugguacauuuuugauuggggaaaaaaagagauuaacuuaaaagguuuuugacuaaugaaaauuaagcuugugccacauucaagcgucauuuuuacacccguaagcacugugaagcauuucccuuuagcaccuuuuaaucuauaccuaugaucugggaaaaccccaguguggagguaugauauagccuucuguugcccuuguuaaaaagagaacacuguuucguugaauugugaggaaaauaauguugauuuagauucuuaguaacuacuuaaggaaaaaaaccuuugaauuaagugaaaacacaagccuuucacuuauugcugcagagaaacauguugaauaucccuuaagugauaguucugugaaauuaguaaagauuaugggagaaaauaaauuagauuaauaaugucuauucuuaaaugugaauuauuuaagguauuuccauaugagaaaaaagccgcagcacugggaggagaacguucagcccuggugauuguccugccacacaggcuccaccugguuuuaaggucggaggugcagaucauccugcaugcaccuguucaccaucaacacagauuggggacgacauuuuagugcuuaggggaguuuuguuugugguuuuggugaagcauaagaauacauuuuauaaauuguaauugccuucuaguuccaaaauaugcagacaguugagcaguuauuaaaguucucaagagaggucaaaacucauagauauucuaguuugauaggaaauuuguuuucuagaauacagaauuugaggaucauuaauuuucuuuuaugggaaauuaaaugagcaagauuaccuggaaaauuacauuacuuuuuauaacaguucuuuauuuaugagaguggauaauucaaagguaauaaauuagaguuaacacuuuauuuucaauaguccuuauuaauauaguuauagaagucauuucugucaacucucaguuaucucuugagcaguuaaaggagauggaugagauugaaauccuggauaacuucaucucacuuuuaaaaaaucuuuucugacaaaauguauauugaaaccacuaacaaauagaaaauguaacugauuugaguuuuuccacuuucuuacuauuugucauuuauccaauaugagucauuaaagugagaaaguauaaaguauguuguuguuuguagacaaaauaaccguaccuggaaauuaaauuucuuuaguaagaaauuucuuucuucuuuuuuucuugagaagaaauuugcucagacuuuuacaagaguaugguuuuguuuuuuauuguauuuuugagauggagucucacuuuguugcccaggcuggagagcauuggugugaucucugcaaccuccaccucccagguucaagcaauucuccugccucagccucccaauuagcugggauuacagucacgcgccaccaugccuggcuaacuuuuuguagauacaggguuucaucauguuggccaggcuggccuccaacuccugaccuuaaguaauccaccccccugggccucccaaagugcugggauuaaggcaugagcuaccgcaccuggccaagagugugauuuuaauugcaguauuuuguaauugaccuuauuuugugaggauuaaugaacuguuaucauuuuacaggucucaucacaacuacgucaaggaagcuagaccgagaacagcaagaugaacacauauuagagguaaguuuuuuuuuuaucuuuaauacuuaaagauucguaguuacaaguaucaugggaaagaacaaucuuguucccauuaaccaguauucuuagcuauuaauauuuuguuguauuaauauuauuuacugguuguuaggaaaaaggaauauaaggaaauuguuaaugaauauagcucuuguccccuuuaucccucaauaccauucccagaauacacagccacugucaugggccggauucagaucuuuguauuuuaugcuugcgcacacacagggggcgaacagaucuauaaacagugucauguggaauucauuugcauuuacauaagugauauuuuucuguauacaucuuuuuuuccccuuacuauuauguuuuugagauauauuuauguugguauuuauagaucuguuucaaccuuuuuaacuagagguaauuuguuuccagauucauuuuuuugcucuuaaacaguugcauuauuuuugcguuuuaaacuaugaauuacuuaguuugugcuucuuaaauaccucaaaaguaaaaguagauugaagucucagaugugcucuucuagaaaguucuaauaaggcuucucauucucauggauaauuuacaaugccuuuuaguccuuagaaaacccacagcuuguuaucauguauuggucaccugguuuuuggcuaauaguaaauacauugcagaaaaaggccgcgaguaauuuggagagggaagguggagcguaacauggacaucagguugaugagaucucugggccgugucgucaggaagcggcugagagacaggcagaccgcagagaggggcguagagacaucucucugucccguguggaagacugguguucauuaucggagccagccuuggaaaaggccaccugccuuuguuuaauugaguuaucagugcucuucuuccacucuaacaguauaagugacaaaauucuaaacuguaacuuuugaaaauuucuuuuaauauugcuguuuauaaugcugccugcuuaauuucauuuuauccuuggucaaauuuucuuaacguugucaguaaauacuuaguuuuuauaguugugcaguguaugugugugugugugugugugugugugugugcauugggaacugggaauacccucuggaaaaggugguuucacagccacagugcuuuccccauuaggagcugcuucauguauuacaucugaguuuuuaguucauaggguguaaaguucgcuugaauucauuuucuuuaugauagagcaaaguuuugaauuuucauucugucacuacaaggauugacagaaggggcaaaugcagucacugacaaagauaaacagaugggaagauaggagagcaguaguuacacugacauuuugcuccaguccuuucaaauuucacauuaauugcauacgucacuccagaguccucuuuucuccgugaauaucaaaggcuagguggaagcagauaccagauauauagcacuuugaaagucauauuuggacauggaugggaaauaaauuuucccuucaacauacauaauuaguguauuuuucaguaggguccuuuuggggugguauauuugagagccagugcuggcauugauuuggcugucuuaaagauagugucuccauuacauguugaaagcugugacuagcuacugguucuugaacccaaaguuaggaacaauuuggugaugaauacuaaaaaacauagugcuugcuuguauuucucuuucuuguuuuucuaaagcucauaugcaaacugaugaaaaggaaauguuucgagaguuuaaaauuaaaauaguaauguuuuauuuugaaaaagcuuaggaagguaaauaauauaaagcaacuacuuaaauacuuuugacaggcaccaucgggauauagucacacuuuaauaaacaggguuuacaacugccagacuucagucuccuugaccguuuuuaguguuuugguaauucaguugggaagaagguagggguguggauaggggagaauaagcauuacuaaugucguuauauuuaaugugcccauugacguaaacgugaacauuugauuuaagggugaaauggucucuuagggacauagaaacagucaucagugcaguccucaagacucucugauauuuuuuccuaaauagaauauaagaauauauggauaguuuacuuaaaaugaaaguuauuuuaccgaaaaucuuauuuaaugaguuggucuuaaauuuaaauguuuagguccacuccuauaaaaaucuguagaggaaaacagccaaaauaaaauggugauuacugguauuaaaagguguacuauuuauuuaacacauacuuuaaaaugacaauuuagcauauuuuacugaugaaguuuaacauuuuuaacaugauauauggaaauuuuguuuuuaaguauguagaguguguuguuuuuaagaagacucuuuaaauguguaaagcagaaucuucacguaucucuuccauggccuaaagguauuaaguuuuugguagcuuaacauuugggugagguucacuuuccacuuaaacuaaugcgagaagagagccugcguggucaggaaggcgcgcaggggugcagcuguuucuuucuuagccaugcccggcccccugacucucucccuguagagaugggaggugcugccucaccuccuuacagcccuguuguuggaaugaagaucugcuguguauguugucaucgugcccugcaaaaugcagagcuuuacacacaugcggaguagcaugaggaagaagaugcucacuuuuuauauaguauaucuuaacauguuaaucuguuaacuuuaaaaaaacagguuacugugacagacaaugguaguccccccaaaucaaccauugcaagagucauugugaaaauccuugaugaaaaugacaacaaaccucaguuucugcaaaaguucuacaaaaucagacucccugagcgggaaaagccagaccgagaaagaaaugccagacgggagccgcucuaucacgucauagccaccgacaaggaugagggccccaaugcagaaaucuccuacagcaucgaagacgggaaugagcauggcaaauuuuucaucgaaccgaaaacuggagugguuucguccaagagguuuucagcagcuggagaauaugauauucuuucagugaguuaagauuguaguacuguaauuuuucauauguugugacuauaaaccuuauuuuguauuuuuucuuuaguaacuuuauuucuauuuuguaaacggcugaaguguuugugaccugcuggccccauuaggcaaugccggauaacguuugagaaucagggugcuuauuguuuauguugaauguggucaugaaaucauuguucuucugucaggcauuccauacacagaauacaaaugugaaauguuugaaauuggcucaguuuaagaccaaaccagucugugcuucauucauuucuggguuguaacuccugauuugcuguuuuuaauccccucugcccaaauguuguagauuaaggcaguugacaauggucgcccucaaaagucaucaaccaccagacuccauauugaauggaucuccaagcccaaaccgucccuggagcccauuucauuugaagaaucauuuuuuaccuuuacugugauggaaagugaccccguugcucacaugauuggaguaauaucuguggagccuccuggcauaccccuuugguuugacaucacugguaagcauucccccucauuuucguuguccguauggguuacacugaggagaaccugcauacgguuugaugaguuuugggcacaagucaggauuuaaaauugggaauaagaucgacagguggagaauuugcuuucaacuauaauauuuugauugcaaaauuuuucacaauauauagcauauguuaaacuugcuuaaaauaggugcucuauucuaccaaguuauugauauaaaaauaaaauuuuguaaaaguuugucaaagaguuacagacaaaagccuugaauguuuugguccagaagcacagcuucuuacuguuuauuuauugaugcauaaccuauggcacauuguuauuuuuauugaugcauaaccuauggcacauuguuauuuuuagugaauaugauuggaacauuuaaaguaacuaugccugugugacugucacaugucaauauuuaauagggaauaagcuuacaaauuuugauucauaccagcuuaugguacaaaguuaugguaccagcuauggguuuuuaguuuuauauuaccucauuuucaacagguaggaggauucauuagauuauuucauccuccaguaaaguuuacuugcuaaagccauuucuucuucuuauuugucauguaguuuagauaagacauugaauguaauacccuauucaacguauuuuuuaaauuucacauuagaguuugcaucuuagauuuuuuuuuauuguuuccucacauuuuaguuacaaggguauuuaagaacaagagucucuguugcgauucaucucucugggggggacuuuauguccauuuuuccccuucugccccuuagucaugcuaacccgaagcccccaaaaguugcagcugauggacccagaccacugggcaugucaggccaggccaggccuuaccuuuggaacuuucaugcuaaaugcuuuggcuguuuuaccaauuuggugauugugugaaauugaugucaucagcaccugugaaacccuuacagcauacuuucaagggaaggggaaaaagagacuauuuucguaguuaacgaugcucaaaaccguuuguuugcuuucuguuaacuuuuaucacauuuccagaucaacaggcugcugcugugcaguaccugaccucgcuguguaaccuugcugugcuuggaccugguuugauugauugcuuuuauucugugcuugcuuuccaugcgcgcuugcuucuuuuuggcugugccaggagacacgcuugcuagagaaguuuuuuacaucuuucagaugacuugugacccgaccuguacagcagaagguaucugcugagaucacauaauuugccucagauuaugagaucuaaaauaaaagccuuguuuuguuuuuguuuuuuuuuacuuuuuuauuuccagugacuaucuuccaucgcuguuuuuuuuuucauagugugcgcauggucacccaucccacucgccagcguguugccacguaaugcucaccuagcuccgugguuuuagguuucucuuaagacgucguguguguuguuuuguuucuugguuagauuuaguaguagaauuucaucaugacauuaaaccucuauuuucaucccauuucauuuuauaucuaggucgauggauuugaaaagagaguuuuaucaaaaauauuuggauaauauuaauaggauagaaacuuuuguuucauuaggcuuuguguuugucaaaaaugagaaaaaaaauucuuuucaaauaguuuauaguagccaggacuaauuaaaguuaacgaccgcuauuuuuuuuagaguuaacauugauuuuuaauagcuauuuuauuaggucaauuugcucaaaguaucagaaaguuuuguuaguaaguaagcuuuuaaauggcccagugaugguaucuacugagauacaaauugaagaggaauucagaaccccugaaaaagcaaauugaaaguaacucauuggcaauauuagcaaugucuuuguuuucagaguugcuuucuugcuuucuuucaguuaguugcuuccuggacaauuaggguucacuuugccuuaacaagcauugucuuucuaauuggccacucuuuucuuucaaaaugcuccuccuuggaagcucuuugcuaguauauuagaagauuuuucagugccauuaaguaugagaaagccacagaauaaacuacagaguguuauccugugaccuguuuuuacuuuuuuuuccccaaauuagguggcaacuacgacagucacuucgauguggacaagggaacuggaaccaucauuguugccaaaccucuugaugcagaacagaagucaaacuacaaccucacagucgaggcuacagauggaaccaccacuauccucacucagguaagugaauuacuaaugacacacuugucagaggaggauggagauaacguucugacuuagggguccacgggcaauaugagcgguggauucugcccugugagggucuaaaaucagaaguuuacacacaugcacacuaagaauuuuuauuuagggaaagaaaauuaauuccauaucccaauuuggguuuugcauauaauuaagcaguuuugagaauuuugagagaagacuucaaaaaccaaaccaaaccaacguuauaccaucaaaaucuucgaauuuuacacucauuuuaaacuauguuaacaucaaguacaucacuguugagaaugaauuguuuaaaucauuuucaguaaaacugguuaaagugauuaaucuucuaaaucacuuuuuuuuggauuccuccuggcuauauaaaauaacuaauaaaauuguucuaauaauuccuuuaccaccuuuauuuguuccuaucugguaauugagauggccagauuauggggauuucaaacuuaaguguuaaaauccuguaagugaaauuuaaauucuguucuuucuuauuacuuuucuuugguucucagugugggccguuuggaguguacagaaggaauauuccuagauagaagaagcauccugagguuucaggagcaagcagagugucauucacucauuuauuuaccaaguauuuguugaacacuuguuacaugccaggcaccauucuggaaggugaauaguaggaaacagaagaggcaacaaucuugcccucuuggagcuuacacugggauggcagaagcuaaaggcuuguuuauaaucuacuguggccuaaaugaaaaagaaagaaguuaaaugucagagaacaaggugcaucugaguuugaaauuuucuagcguuagauuauccuguuuuaaguacuaagcaagacagaucaucugcuaacucauuuagcugcauuaaaagauaaaaauuauagucggugaugucuuuucgauuaauaaauggguagauaauuuaaagccauuuacaaaaauauuucuuucuccaaaugcuugugauuuuuaguguauauaaaauugauacauguauguuauaugcuuuuggggucauuuugagauugucuuguaaaaguucuaguauggugucaaaauuucaauuuaguugguagcuguucucauucuagagacaagcaaaaucuauugauuuucucucuuuaaacauaagcccuuguaaaauuuuagagcacaaaaaugagaauaaaaacaucauaaauuguaauaaaucuaauaggauaauucugagagaaggauuuaagggguauaacuguagaccaauucacagaaucgacuacccagaaaucuaacaaaaggagcuucauaaacaguggagcugucccucuuugccaagcauucucauuacuaaagacccuacgucuaugaauaauuaacagugcaccucuuucccaauaauuauauuuuuaauuagugcaguuaaaaguuuagcaugaaauaucacgugcaccaacuaaaaucccuauaaaacccaggaaguguauucuaguuuucuuucuuggaaacacaaaauaucuuaaauuucauugcuuccuuuauacuucuguaacuuauuuuugggccauugucauaggcuguagaugcuauccuaaucgcuggcagagaaaggcagucggacuauaagagaacaguagcccagguugaccuguuaaggugugggacaaagggaaugauuuguguuuagauuauuuuuccucuuuagcugagaaccuggaaauaugaauuugggugggggcgggaggggggugcagcagcugccaccuggagaagagcacaggaaucagcuggacagugagaggcaccaggauacagcggggauggauugaaaagcagagggaucagcugggcggcgagacacuaggauacuguggggauggauugaaaagcagaggagucaccugggcagugagacacuaggauaccgcggggauggauugaagagcagaggagucagcugggcggcgagagacuaggauaccgcaggaauggguugaagagcacaggagucagcugggaggugagacacuaggguacugcagggauggauugaagagcagagggaucagcugggcagugagacacuagcauaccgcggggauugauugaagagcacaggaaucagcugggaggcgagacacuacgauaccauggggauggauugaagagcagaggagucaccuggacggugagacacuaggauaccgcggggauggauugaagagcagagcagucagcugggcagugagacacuaggauaccgcggggauggauugaagagcagaggagucagcugggcagugagacacuaggauaccgcggggauggauugaagagcagagggaucagcugggagaugagacacuaggauacugcggggauggauugaagagcagaggggucagcugggaggugagacacuaggauaccucggggauggauuggggcuuggaaguaacacucagaagucaacagagcagccauuguguauccaggucaggggcagcagaugccgauuugagaagguuuaggugagccguuggugagucaagcgggcagccuccagcagagguaggcggcaggacagugggagaacugccagugcccugcggaaacagcucuucucuggcuuuccuguccugcguguguggcuuaggaugcugaccgccauugauuccagucacuuggcuuuaucuuguaucuccagguaacuuaccaaauccaguuaccuuuuuuuucuuucauucaaacaacuuugcuuucauaucuucuuuaacuuucucucgagcaucagcaucguggccucuggagcagaucacuugguuugaaucccggcuccaccucuuguacuccuuuccaugggcaaauagcuguaacucucuguguguccauguucucaucuacaaaguggggguggugauaaucguccuuuuggaggucuuaggaagguugaugaggugacccgcagggugcuuguucuucacguucugagagccugucacccaguaagcacgcagaaagccauagucuuguugcacaucagcacugguuugggcucuugucccaccaacacucaauucaccuuccagucgccauucuucaucccugccacucauguuggaagcgaguuucuucugaccaaaaggagcuguguaguccucccacaucaguucuggagucgaggcucugcguauuugacucugccuucuucuugcuccuuuacuguaucaccccugaguuccaaguccucuccagccucugaaaggcaggauguuccgucccacugcuugccuucaugucguugacgcagcccuuccucauacuuacucaccugccaaccaaaaauguacccaagaaagcauuaucuccuuaagagcuuucugaauaucucagccagucucuggacucuuaaaaacuuuacaugauaauauaugagacaugguuaggcugugcaugugcagaacauugccugguaagccugguggcucuaugagggcagagaccauugcaugcugauuucacacccaggcaagcauugggcauggaaacgcacaauccguguguuucaauugaauugcuuugacuuccaguucuuucuacuuaauaaugcuugagcuuggagcaggauuaaacuucucugcucaguacccacuacaugggaaaaguaauuuuuaaauuuauaguggaaaugaauauguaaucuaaucuaugguaauugccuuuauagccaucccuucuggaucaucauugaccuguaaaagugaggcaucuguaguuuuaaagguuuacauagcuuucacaugcaaccuuuccgugguuugguggaugcaucuggaauucauacaaaauguaauguuacguuuuauuuaacuaaaacauccuugauauuuuggucuucugugagaacacugauguagcccucauggaaggaaggccucuguucauggccugcaccaugugguugaccgcucugccugggacccuggcccccugugcugcuuggaccagcagaucccuuuguuccauaugcccccacgaagcgcaguuuucuucuucuuaaacucuaaagcauguuuuauaauuggcagugauuuccgcugugccaaauccauacgucuuuucauuauggaaauuaauccucuuacugucaaaguuuuguuuguuucuaauuuagcuuaguaccaaguuucuuaacauuugcuuuuuuccucuaaagguuuuuacuuuauguagacauaguuaagagaguuuauuuuuucaaucuauugacuaaauugguuuuagggaguaaacauauuuacuacauagauguagguuuaugaucacagaaauacagugauuucuaaacacauuucuuauuuuuucuuuuuacguauuaaaaaaaccuaugaucaggggcuugggaugucaaagaugagaaugagaaauuuggauaguguaaucaucugucuuaccucaguggguugguaguugcagauacaaaucugauuuaagaaauuagucuucuauaaauccugguaaauuguuauccguacaugagugaccuacagauaccuucucuguggaggcguaagagaaguuaagcccacguaaagacguggcaagugugaaaaucaauacauauuuugucccagaguuaguuauaagaaugcagaaaggucaucauuaucuuacucauauuuagauaaguaauauaccaaugagaaauguuuuaagaaauguaugauucuagguuuuuguugccuuucucguauuuuauuuugccacaguaucguuucaauauacaugacuuucguucaugguucuuuaaguauuaaaacauucauaauuggaaauauuguaugagucauuuugucauccauuacagguauucaucaaaguaauagacacaaaugaccaucguccucaguuuucuacaucaaaguaugaaguuguuauuccugaagauacagcgccagaaacagaaauuuugcaaaucagugcuguggaucaggaugagaaaaacaaacuaaucuacacucugcagagcaguagagauccacugagucucaagaaauuucgucuugauccugcaaccggcucucucuauacuucugagaaacuggaucaugaagcuguucaccagcacacccucacggucaugguaggcgcucuacccgcucuccucccaccauuugguccugaggccuuuguguguucgagcgugauuuuuaauuaguuauaaggaaagcaccaaugggauugauaaugugucaauucuuuuuagguacgagaucaagaugugccuguaaaacgcaacuuugcaaggauuguggucaaugucagcgacacgaaugaccacgccccgugguucaccgcuuccuccuacaaagggcggguuuaugaaucggcagccguuggcucaguuguguugcaggugacggcucuggacaaggacaaagggaaaaaugcugaagugcuguacucgaucgagucagguacuuuuggagccuucaguggcauuuuaaauuugcaguuguuaaaagucuguuucuacuuuuccaaaaucaguucuggguauugaagcauuucuauguaucugcaaaaauggcuuaaauugaucucuagauacaauuuuacauguuaggagaaaggaauuuuuuuuuuuuuaacuuuuagcccaucagagaguuugggggaaguucugggggauucacaauauuagcccaguucaaggcucugagaagccacguaguagaggaaacuuuauuugaccaauucaguauuucugaaauuauuuuaaccacaguuucuucuguaacauugguuaaauuaaacacacuuaggaagcugcuugccuaguaauuuaacguuucacuuuuuugucagagaguauuuucucuugagcagagcaggaagcuccauaacaguguugacucaucucauuguaauuggcugaaaccucagaaagaggugucgugccccucccaccccuuccacauuuaccuggauuuuugccacucgccuuuaacagguggauuucccucauggaauuggguugaggacuagaccccagagcuggggccugcugggguggggcuugaggcagcaagggcagcaaaaaaaacagcuggagcugcgguccuggacgguuccgggacccagaggccaagagauccagagucgggauaacaagggggaccaccaggaagcaguccuggcauagcaggauguuuuuggucuguuuuccacugccauucccucauucauucauucauucugugggcugaugaagcucguuuuaugugucaggugccauguuggucacucauucauucauucugucggcugaugaagcucgcuuuaugugccaggugccauguuggucccucauucauucauucauucauucauucugugggcuggugaagcucacuuuaugugccaggugccauguuggucccucauucauucauucauucauucauucugugggcuggugaagcucacuuuaugugccaggugccauguuggucccucauucauucauucauucauucauucauucugugggcuggugaagcucacuuuaugugucaggugccauguuggucccucauucauucauucauucauucauucugugggcugaugaagcucgcuuuaugugccaggugccauguuggucccucauucauucauucauucauucauucugugggcuggugaagcucacuuuaugugccaggugccauguuggucccucauucauucauucauucauucauucugugggcuggugaagcucacuuuaugugccaggugccauguuggucccucauucauucauucauucauucauucugugggcuggugaagcucacuuuaugugucaggugccauguuggucccucauucauucauucauucauucugugggcugaugaagcucacuuuaugugcgaggugccauguuggucccucauucauucauucauucauucugugggcuggugaagcucacuuuaugugccaggugccauguuggucccucauucauucauucaugcauucauucugugggcuggugaagcucacuuuaugugccaggugccauguuggucccucauucauucauucauucauucuguaggcugaugaagcucaguuuaugugcgaggugccauguuggucccucauucauucauucauucauucuguaggcugaugaagcucgcuuuaugugccaggugccauguuggucccucauucauucauucauucauucuguaggcugaugaagcucacuuuaugugccaggugccauguuggucccucauucauucauucauucauucuguaggcugaugaagcucacuuuaugugccaggugccauguuggucccucauucauucauucauucauucuguaggcugaugaagcucaguuuaugugcgaggugccauguuggucccucauucauucauucauucauucuguaggcugaugaagcucgcuuuaugugccaggugccauguuggucccucauucauucauucauucauucuguaggcugaugaagcucgcuuuaugugccaggugccauguuggucccucauucauucauucauucauucuguaggcugaugaagcucacuuuaugugccaggugccauguuggucccucauucauucauucauucugugggcuggugaagcucacuuuaugugccaggugccauguugggaguguuccuccugggcaugguacguaggcguugccauuggguccacaaugcgugucuuguaaaaguuccaccccgauagaaacagggcucugcuuuagagcauacagucuguacaaucagaagucacguugcuuuaggauguuccugcucaugccagauccucugaaagugaugaaauguugggaagacaguuuacaguuuucuguuuucuucagugccauuguuaguacaaggaauauagucccuuucagucuucuucauaaugaguuuagagaauuaaaauauuccauuuaacuuguuuucuuuuuuaagucuguagcucuacauauuuagaaauugucucuccuaggcauuagaauugguacagguauagauuaauuauagaucauguaauaaaaauuugaggaaauggagaguaauuuuaaaaaacuuacugauguguucuaggugguuaaacuauguuuauuuaacauauuugaaauuucauuuguuucccuuaaaacaaccaaaucgaguucauuagucacaaauaagaucucauacacugccugugauugcaguguuaaaauguaguguaguuagugccuugaguaaagaugaaguuuuuuuccacugguugagaaauuugcaguuagaaaaacagugcauuccauuugugcaugccugcguacuucaauaaaguaauucugucauagacaaacugacuggguuuauguaggagaaaauguuaaacuuccccuuagcuuucacauaauugucaacaacugggugguuaaaauaugauuguuggugucugaguagaagcaugugcauucuuugaaugcuucuaaugacugacaggauuaggaaucugguauucagagaauggaacucccuccuccaugaauagauaauaccaauggccuauucuggcauagaauuaggacuuuuaagaugcuauuuuuauaguuuugguaauauaaaaauuaugcucagcaguuacuuuguaggagaccacuaccauuaaaaugcaguagaauuuuguggaaggggugugugcauguguuggagauggagguggacaucuguuggaauaguacgaacuauaaaauguucauacaaaugccuuucauuuaaguuuauucauaauuaucugcuucuaauuugugucagauuacauuuaaaguucaaaaagacuaguuacaaauucaguacguaacacugcauguuuaauuagcagcaauuaauugaguaaaagguuuggucugauuaggaguauucagggaaaaaggaguuaauuaagagauauuuucaguaaccauugaguuauaugcuggagacaugucagugccauacucuggucuguguguuuucuucuuacaucuuuuuaaaaaaguagauuauuagagcacuacuucuaaaccauuuuaauaccuggaaauagaagauacuccauaaauaaauauacuuauugauuagaauugguuuuccuccccaaacuuaaguaauugccuugagagucaacggagggugccacucugccagucaguggggccccagcugaacauccagugugugucuacaggggaagaaacagacuccccuucacaguucuguguaauauacuuaauagcuuaagaguaaaaauuagccuguuugucuagauaauugcccuguucccauacagggaacaauuuaaaguuguuuaaaaaucacucauauuguagcuaaagucagugaauaagcccccagccucguacagaccuuuucugccaccuuaggaagucguucaacagcaccagugcaucucagugucugugaaugaaccuguuguuaggccaggcaggggcacuuucuaccacucagcagcccucauuguuucuucacauaaacacgaugcugcuuucccaccugcaaaucugaugauuucugccuuaaucuauauggaugugggauucauguaucccaucacgagcuggguuccuguuuaaccuuguuaucagugacaugcuccaagcuguguucaccagagucaugaugccccagauaauagaggauguuucugaaucuugcauggccgauaaagagcaagguuguaauccaugcuguaaagaaaacacagggcgaugagacagaaacaguaagaauagcgggaggagacucuuccaggagaggaugcaucagacacuggggcucugagaugagugugcucuccugauugaggacaaagagaaugcccacuuggcuggagggcagggagcaaguuuugcagaaagcaguguguucuagcagcaccagccuccuccacagcagauagucucuucguuccuccacaugaggccuugcauauuugaagcuucaucggcaagauaagauuauccuguacaauaagagagaaguggauauagaagaaugaauauaaaauaugguaggucagcuggugaguacagacauagggaagucugaggggcagggaugaagagagucaccauggcugccccagucuccugugucaggccaggcagucagucacaauuuuagacagugagggugauguacaggugggaugagaaaaggaucuuggcguucugacgacggccaaaaaugcaaucaggaaggaccugggaucacugacucauaaguacagacaggccggaaauuagugucucaaaagccuggcagaggcagcaggacccaguucucggccaggguucagcucagagcgucagggccuagagaaacccugggccuccacccuguugcagacugaggcacugccuuggggcucggaugcagagccaguaagacuuaaugaaaagcaggcuggaucuggucucuaaaaaauggccguggauuuuuggaaaauguaugaaaggaaggaagugaagacuguagaggaaguguuuccuguuaaugauguggagaacaaagugcuuggugaaucccuggugugcagcucacacugagcaguucuggucugugaaaugccacacucguggcaaaccuagagcaagaaucugagaaagcaguuaaguggcaagugagcuuuguuuuggguaaguauaauaguucauuuggggaaaauaaauucugugcuaugacagggauggugaauucugggugcuuguucaugaaacagaaaaaggaugggcucguggauggauuaaaccugagaaccugcaacgccacccugauuuauccaaaagggcuguagagaacugcuuguuucuuugaagauucagucgaugauacaaaauuauacaauauucuggaguugugguugcagcuaaagauacauacaguauagccugaaaagguccaaagaaaaggagguaaaacacucuaucuuugagcagccucucagcuucagcacugcugacauuuggaaccagauauuuuugguuguguagggcuguccugugcguuguaggaugcuuagcaacaccccuggucuccacccacgagacgccaggagcacccucuuccgacaaguagugacaaccaaaaaugucugcaggcauuaccagaugucuccuagggagcagaauugcccccaggggaaaaccacugaccuagaggauaaguugaccugaaaaagauaagaagggaauguuguugcaaucuucaaaaccuguaaagugggguggguuacacacauuuauccauggacaauugucucuugaagcuugaugucaauuucuuacugaaucgaaaucuuucguaaugaauacauaucuuaagaauuuguaagucauaaccguugaaaauacaaaugugguccagaaguguuuugagggacuccuggaaagugacucacucaacugcuuuguggaaggauagccuugucuuuccaccacacauucccagugcagccgagagagggaguuuuggcuucgcuaagagcagagugcuguuucuucuguuuuuuguuuuucaucauuuauggacaaaauucuguaaaguauaccugguuuuagguggauaaaaauaaaacaaguugaagguuccauucaaauauugacauccccugaguuucugcuuaauuucagaauauaauuuuuaaggauacuuuguuucuguuucucuaacuacuacuacuacugccccuuguguuuuucuguaacauguauuuuuuccucuccuuccaggaaauauuggaaauucuuuuaugauugauccugucuugggcucuauuaaaacugccaaagaauuagaucgaaguaaccaagcggaguaugauuuaaugguaaaagcuacagauaagggcaguccaccaaugagugaaauaacuucugugcguaucuuugucacaauugcugacaacgccucuccgaaguuuacaucaaaagaauauucuguugaacuuagugaaacugucagcauugggaguuucguugggaugguuacagcccauagucaaucaucagugguguaugaaauaaaagauggaaauacaggugaugcuuuugauauuaauccacauucuggaacuaucaucacucagaaagcccuggacuuugaaacuuugcccauuuacacauugauaauacaaggaacuaacauggcugguuuguccacuaauacaacgguucuaguucacuugcaggaugagaaugacaacgcgccaguuuuuaugcaggcagaauauacaggacucauuagugaaucagccucaauuaacagcgugguccuaacagacaggaaugucccacuggugauucgagcagcugaugcugauaaagacucaaaugcuuugcuuguauaucacauuguugaaccaucuguacacacauauuuugcuauugauucuagcacuggugcuauucauacaguacuaagucuggacuaugaagaaacaaguauuuuucacuuuaccguccaagugcaugacaugggaaccccacguuuauuugcugaguaugcagcgaauguaacaguacauguaauugacauuaaugacugccccccuguguuugccaagccauuauaugaagcaucucuuuuguuaccaacauacaaaggaguaaaagucaucacaguaaaugcuacagaugcugauucaagugcauucucacaguugauuuacuccaucaccgaaggcaacaucggggagaaguuuucuauggacuacaagacuggugcucucacuguccaaaacacaacucaguuaagaagccgcuacgagcuaaccguuagagcuuccgauggcagauuugccggccuuaccucugucaaaauuaaugugaaagaaagcaaagaaagucaccuaaaguuuacccaggaugucuacucugcgguagugaaagagaauuccaccgaggccgaaacauuagcugucauuacugcuauugggaauccaaucaaugagccuuuguuuuaucacauccucaacccagaucgcagauuuaaaauaagccgcacuucaggaguucugucaaccacuggcacgcccuucgaucgugagcagcaggaggcguuugaugugguuguagaagugacagaggaacauaagccuucugcaguggcccacguugucgugaaggucauuguagaagaccaaaaugauaaugcgccgguguuugucaaccuucccuacuacgccguuguuaaaguggacacugaggugggccaugucauucgcuaugucacugcuguagacagagacaguggcagaaacggggaagugcauuacuaccucaaggaacaucaugaacacuuucaaauuggacccuugggugaaauuucacugaaaaagcaauuugagcuugacaccuuaaauaaagaauaucuuguuacagugguugcaaaagauggagggaacccggccuuuucagcggaaguuaucguuccgaucacugucaugaauaaagccaugccuguguuugaaaaaccuuucuacagugcagagauugcagagagcauccaggugcacagcccugugguccacgugcaggcuaacagcccggaaggccugaaaguguucuacagcaucacagacggagacccuuucagccaguucacuauuaacuucaauacuggaguuaucaaugucauagcuccucuggacuuugaggcccacccggcauauaagcugagcauacgcgcaacugacuccuugacgggcgcucaugcugaaguauuuguggacaucauaguagacgacaucaaugauaacccuccuguguuugcucagcagucuuaugcggugacccugucugaggcaucuguaauuggaacgucuguuguucaaguuagagccaccgauucugauucagaaccaaauagaggaaucucauaccagauguuugggaaucacagcaagagucaugaucauuuucauguagacagcagcacuggccucaucucacuacucagaacccuggauuacgagcagucccggcagcacacgauuuuugugagggcaguugauggugguaugcccacgcugagcagugaugugauugucacgguggacguuaccgaccucaaugauaauccaccacucuuugaacaacagauuuaugaagccagaauuagcgagcacgccccucaugggcauuucgugaccuguguaaaagccuaugaugcagacaguucagacauagacaaguugcaguauuccauucugucuggcaaugaucauaaacauuuugucauugacagugcaacagggauuaucacccucucaaaccugcaccggcacgcccugaagccauuuuacagucuuaaccugucagugucugauggaguuuuuagaaguuccacccagguucauguaacuguaauuggaggcaauuugcacaguccugcuuuccuucagaacgaauaugaaguggaacuagcugaaaacgcuccccuacauacccuggugauggaggugaaaacuacggauggggauucugguauuuauggucacguuacuuaccauauuguaaaugacuuugccaaagacagauuuuacauaaaugagagaggacagauauuuacuuuggaaaaacuugaucgagaaaccccggcggagaaagugaucucaguccguuuaauggcuaaggaugcuggaggaaaaguugcuuucugcaccgugaaugucauccuuacagaugacaaugacaaugcaccacaauuucgagcaaccaaauacgaagugaauaucggguccagugcugcuaaagggacuucagucguuaaaguucuugcaagugaugccgaugagggcuccaaugccgacaucaccuaugccauugaagcagacucugaaaguguaaaagagaauuuggaaauuaacaaacuguccggcguaaucacuacaaaggagagccucauuggcuuggaaaaugaauucuucacuuucuuuguuagagcuguggauaaugggucuccaucaaaagaaucuguuguucuugucuauguuaaaauccuuccaccggaaaugcagcuuccaaaauuuucagaaccuuucuauaccuuuacagugucagaggacgugccuauuggaacagagauagaucucauccgagcagaacauagugggacuguucuuuacagccuggucaaagggaauacuccagaaagcaauagggaugaguccuuugugauugacagacagagcgggagacugaaguuggagaagagucuugaucaugagacaacuaagugguaucaguuuuccauacuggccaggugcacucaagaugaccaugagaugguggcuucuguagauguuaguauccaagugaaagaugcaaaugacaacagcccggucuuugaaucuaguccauaugaggcauucauuguugaaaaccugccagggggaaguagaguaauucagaucagggcaucugaugcugacucaggaaccaacggccaaguuauguauagccuggaucagucacaaaguguggaagucauugaauccuuugccauuaacauggaaacaggcuggauuacaacuuuaaaggaacuugaccaugaaaagagagacaauuaccagauuaaagugguugcaucagaucauggugaaaagauccagcuauccuccacagccauuguggauguuaccgucaccgaugucaacgauaguccaccacgauucacggccgagaucuauaaagggacugugagugaggaugacccccaagguggggugauugccaucuuaaguaccacggaugcugauucugaagagaucaacagacaaguuacauauuucauaacagguaaaaaaaauucauaccaaacgguuuaauuaauuuaaaaugauuuuuagaagcauaaaguauaagaucuguauuguauggaaauuggggauuuaagggaugauuuuaguuaaaaauaucuaaaauaauacguagaaauaacaucuguugagccucauuucaagcuuguuaccugagcaaagcuaccaguuguuucauuagacuguuuuugauuuuugugacucauucuuuugaaccuuauacuuaguguauaauaaauauaauuaaaaacaucuauaguuuuaaugcaggcuaaaugauuaguagucuuaaugcuauguuuaugcauuuuaaugcugcccuuguuuuuguaaauuggaaggcuaauauaugccaaauuaauucuuuuaauacucaauucuuuuaaacuauaacauuauacaucuuuuguacaguuuauuuuuucuguuacuuauuuuuauccuuucaacaaauuugauuauuaucuuccuccauugauuuaauaggaggggauccuuuaggacaguuugccguugaaacuauacagaaugaauggaagguauaugugaagaaaccucuagacagggaaaaaagggacaauuaccuucuuacuaucacggcaacugauggcaccuucucaucaaaagcgauaguugaagugaaaguucuggaugcaaaugacaacaguccaguuugugaaaagguaagcagcucuucccuuacauuuguguguuaugaauuucaauuucuuaauucuuucaaugggaccaucauuuggcgcugugguguaauucacauguguuuuaugaucacuuacugauuaagcagagguguuaaaugggguaagacuuggaaaagcuucagaacuauuugcgggaaugcucaauaaaucaaaagccucauucuagaaaacuaaauuacggacaggacuccaguugcauccaacacugaaaaugcucuguaaccuuuucaugaggggauucucuuaauauggggauacagcuguuuugggggaaggaucugacgggaaacaaagugccgacgugccgugagacacuguuuugggggcaucugcucuucugcacgcuggagaagcucagagguggacagcgugcuuccugcaucugcgcggcucaccauucagugggaacuaaaaguagacguaggaagggcugcucccuccaagguuagaugagggcauguggcucgagcagggguggucccuggggccagagggugagaagggcugcccagagaaagggcuggcucagcuucggggggcaguaagugggucgucaggaguggguggggaggggccauggagugugaggagggauugugggaguagccacugaguuugccagaaguggggagucugcacugagagucuuggaaaagggugaacuggauuacagugggcaguggcggucguuccaagggauuugaacucgauccuagagaaaauagggacuuuggagccuuuuauaucgguaagguagagaugacaugagacgaguucuuaagcuuaguuuggaagcaucgugcccauuauuuagacagggaggaguggaugcaagggggcccuggaaaggcagagguggggaaggagugaaaggaccaaagccaccaccgaggaagaccaucuggugugacagccagccagcaugccaucgagcccgacuuucuacaugaguagggggagcgaccaaggccguggcaaagaggagucugagccgggggcugguuuuagaggaguuccguguugaguuccaauuccaguuugcuaaaguaaugagacauacaguugaccauguuuuuuagacauugagagauggcgagauguuggauggguauuagggaaagguguggaaacuuggcguugucucuggauagcugaaaauugacuucauuugagaggauacuaacaaaagggaaaaagaagagagagcuauuuccaaagggagaagggagcugagcuggaaggaagaggaggacaccagugcagugccaaccuggguuggggagaagaggacuuuggggaggcaggguggcgaguggagcugggauguuugggaugcgaaacagaccauuugggucccgugaugcuguguagguggcggucuugguagcaggacguggauggaugccugauggcagaucagagagugaagugaugaagaaauagaccugcccagggaagaaggcugagagugacagggaggaggaaugugcugggccaggagaaggcuggguagagaggaaugugauugugaagaggauggaggaguuggaacccaccacagguucugugagucugagaugcuuguggcuguggaaagugauagggcuguucucagggaaagacuuaagauggaagaacccuuauauucagucaugaggggaaggggaacuucugagggaugaggaguuaauuccaguucuuauuuguacuuuauauuuucagaaggggugcgacauucucucucucuuacagcaacugucuuugguuguuuuuuagcccuuugauauuauuucaguacaauacucuaucaucuucaggaauaagacugggacacuagauccuuuaaauucauccuauuaugaaauacccuuuuuccugaguccuuuuucauggaguacuuuuccgugaguacuucacugguaguugaguucagauuaagaaaaucaacagaaucuuaaucuuuuugucuuagguuuuaauuuauggcauggauuucuaaauaauuggaacuggaaacaaguguucaccguguuugagcaugagggcagaugugaggagagagggcaccaggaucacgcagggcaguagaagggccucagccuucaucagagucccuucuguggccuucgagaaucuucguuuucucccauaacaugaaacuugcuucucucucaacugcaguuauuuauguuaggaacauuugcaaaaaauaaauuccuguauuuggaaaugagcagauaugauacgacagauauuuauucucugcaguuuuuagguaaauacggagcacuacuuacauuuuugauuaguacuuacguuuucucauaaggauuugaauaugaaaucagcuuaauaacauauaauagcauuuuguagguuaaaugucaggccaggcucuuucagggauguggagcugguggcugcuccacggcuccuccuuguuucacauguguuuuauguuuuaugagaaaaaucguuuucaaagcucuugggauuuuaucuuuagucauuucccauguuuucuguggucaaagaugaaugauuucuuuuccauuauucccuugauguuugugcugccuguuaaugcuuuuauguaacguuuuuguuuaaacucuuugcagacuuuauauucagacacuauuccugaagacguccuuccuggaaaauugaucaugcagaucucugcuacagacgcagacauccgcucuaacgcugaaauuacuuacacguuauuggguucaggugcagaaaaauucaaacuaaauccagacacagguaaugauggaguuugggacaaaauaaauuguauauuccaacaguaucauauaugugggugauuuuagaucacacacaaaauuugaaauuacauuuugcccuuuucaaauguauucugaugcuccgaaguugacaucucuuagaaaucuuaccagcaauuuagugcguaaaauucaaggugagauuuuuuaaaaaacagcaagaauaucaccuaauugaaaaaaggauuuaaaauuuagaaggcguuuauaccacuuguuuaaaaaaaacaacccucagaaauuaaaauauaacucaagcuuucugcuuuuuauccauuuuauuuaaauagcauauuuucuugaauuggugaccauaaauuuauaacuuagcauaauuuagaauuuucauaaacaaaaugauuuaugggauuuuauuuauuuuaaaauagaguuguuuuccuuuuguauuuugguaaaauugggaucaacuaaguuuccuguuaagccuuuuuauuuucuuccuaaagaacuaauugugaacaugugaaucuaauuuuugagucaauuuaaacauuuuuuaaauuuugguaaauuugguagcuguuucaccugugcaaucuuauacacaaggugagaggcccuggccucagaccugcaggacuuaaagagcuagccccuggcaggguuggagaccuggagcucacugccucuugcagcuguugaaucugucauugauaauacuggucucaagaggaaggcugugaauacucagacuaaguaauugaaagacaaaaggggaggaaauaagauguacaacugcaagucacgucuuaaauuacaagugaguccauuuguuuuuguuuguaggugaacugaaaacgucaaccccccuugaucgugaggagcaagcuguuuaucaucuucucgucagggccacagauggaggaggaagauucugccaagccaguauugugcucacgcuagaagaugugaacgauaacgcccccgaauucucugccgauccuuaugccaucaccguguuugaaaacacagagccgggaacgcugcugacaagagugcaggccacagaugccgacgcagguaucucccgggaaugcucuugccugacgcugcucacugagauccuaggagccucuguuucaaaacacaccccagauucagccugugccacucacuccaccucaugcauguuccauagcccuuccuuguggaaggaaaucuuuagaauaauuaauuaauuuuuaaugaauauuuaaaguuccaaaguugugcccagugaaccuacugcugugaggucucuaaaauucugguuacugaauauuaacugaucuucacaucccauugaauuaaucagugauguguuauuuugucaauaaaccauugaggacagagagagcuuuuagccucauugcaacauaauggaagcaaaugcuuuaugauagguuuacaaaccuuucaaaauuuuuuuagagaaaauuggacuauagaauguauauuuguagcauuugauagcagagaauaacuucuucagucauaccacagguugaguauuccuuauuuauuauaguuggaacuagaaguauuuuuggauuuuuggauauuuuucagauuuuggaauauuugcauuauguacuuaucaguugaguaucccaacuccaaaaaucugaaauccgaaaugcuccaaugagcauuuuuuuuuaaagcaucgguucugcacucauaaaguuaauagauuuuggagcauuucaaauuucagauuuucaguuuagggauacucaugcugugauucugagaaguuucagaagaauagcaaaaguguugcuuuucagaucuuugucaccaaagcucaaugauaaacagaugugauuuguaaagguuuguuagguacuguauuauuggcuccuauacgaaauagucuaagaagccagauucccaugaaauuauauuuacauuuguuuuaacagaguaaguuguuuaccuuuuaaaggucauagucauacaaauuugcgaauaauguauauuagcguuuacccuucuaaaaaaauuuuguuugguuuuuaaaaaaaaaaaaaaaagcguuggccgggugcgguggcucacgccugggauccuggcacuuugggaggccgaggcggguggaucacgaggucaggaguucaagaccagccuggccaacauggagaaaccccgucucuaauaaaaauacaaaaauuacagugugucuguaaccccagccacucgggaggcugaggcaggagaauugcuugaaccugggggacagagguugcagugagccaagaucacgccacugcacuccagccugggcgacagagggagacuccaucucaaaaaaaaaaaaaaguguuaaacuuuuuuauuuaaaaucuuuugacauguuuuuaugucuucauaggauuaaaucggaagauuuuauacucacugauugacucugcugaugggcaguucuccauuaacgaauuaucuggaauuauucaguuagaaaaaccuuuggacagagaacuccaggcaguauacacccucucuuugaaagcuguggaucaaggcuugccaaggaggcugacugccacuggcacugugauuguaucaguucuugacauaaaugacaaccccccuguguuugaguaccgugaauauggugccaccgugucugaggacauucuuguuggaacugaaguucuucaaguguaugcagcaagucgggauauugaagcaaaugcagaaaucaccuacucaauaauaaguggaaaugaacaugggaaauucagcauagauucuaaaacagguaaccuaccauguaucugagaggaaacccuucauuccaccaagaaaacuagauuugcuuaaccacguugccuuguauuaagugacccuguguugucaguagauguucuaaaaaaggcaaaucaaguuuucuuuuaguuauuuacagugggauugaauguuguuuggaaggcuucagauuauaguucuacuuaauacauuuugggcauguucauuauaaaauacaagcaaauuaacuuaaaauagaaaaucaaagcagcauguucuauuaguuuaguugagauguaagguauagcaaguuaguaaagauaagaauaggggauaguagagguccuuauguaaucagacucauggaugguaacuucccaagugaaauaguaauuccagucuuuuuuauuuuaguuucuguagugggcuucugauaauauauuaaguugacuucguuaucaugcuaguugucuauaacaguuggaguacuuugaaucacaguuagggaaagaccgccaacaagcucaaaaggcauaggaacugcugacuccugcugcgugaaugcuucaucaucuugcuaaccuguggccuaaaauaguccuaagucuuaaaacaguguagaaaguugcuccauucaaauuuauauuuauauaaauuauauaaauuuauauuuauauaaauuauauaaauuuauauuuauauaaauuauauaauuuauauuuauauaaauuauauaauuuauauuuauauaaauuauauaaauuauauaauuuauauuuauauaauuuauauaaauuuauauuuauauaauuuauauuuauaauaaaauuauuuuuagggcucuuuaggacuagaaugaugugaaagauguuaaaaggaauuguuuaaaaagggauuuuuaaaaaugagaggauguaaauaaaggguuaucuagaaguuaaaaggauauaaaucuccauuuuaaaaauaugagaaggaaaauauuuuaaaaagaugagacaaaaaaugaaaccgaaagacacaauagaauuuuuacguuuuuauuuuguugauuaaauuagagugaagucgagugagcuaugguauggaagggaugauacaaucaucauguuuauaauaagcagggauguaggugguguugacuggaaaagcaauuuaaauaucaugaagaauaucaugaaaauuaagagaaauaaagauccagggaugggcagauucauaguuuuuaauuguugaauuaagaaaauaggaaacauacguaaaugguaaguaaacuuuugaagugaaaacuaaauguacucaaaagcauucaucuauuucagucauagugggaaaaugugguggcauugcagaaugcuggaaguaauuuugauuucuauucaggggccguauuuaucauugagaaucuggauuaugagagcucucaugaguauuaccuaacaguagaggccacugauggaggcacgccuucacugagcgacguugccacugugaacguuaauguaacagauaucaacgauaauaccccuguguucagccaagacaccuacacgacagucaucagugaagaugccguucuugagcagucugucaucacgguguguauuuuuuccccauuacagugaaaacuguguaucuucuggaucuuugcaaaaguuuuuaguaaaaucaaucuaguuuuuguagcggccuuuguaaauauuuuggagauuugaaagugucuuuuguuaggccaacugauugcugacuuuguuaugaauaauuguguuaaaacagcuaagcuaacccugucucuacuaaaaauacaaaaaaaaauuagccaggcgugguggcgggcgccuguagucccagcuacucgggaggcugagacaggugaauggugugaacccaggaggcggagcuugcagugagccgagauugugccacugcacuccagccugagugacagagcaaggcuccaucucaaaaaaaaaacaacaacaaaaagaaacagcuaagcuauuaauaucacaaauuuuguguaauagguuuaggccucuucuuagcugucuccuaaacaggagugugguguguucuagguuauggccgaugaugccgauggaccuuccaacagccacauccacuacucaauuauagauggcaaccaaggaagcucguucacaauugaccccgucaggggagaagucaaagugaccaaacuucucgaccgagaaacgguaagugaaaaagguugauuuacguuguuuacaaaucaccacaucaauaacuagaaaugccuugugcucuugucugcugggcguggugugagcaggacugaccgccucaagaacugacggcaacauguaaacacucgaaaagcaaugacacuaugaagaucucaaugugagaaauguguuccaugcuaggauaaaguuuggauaauaaagcuuugcauucaggaaggaauuacuguugguuccaguguucugagacacuuccuaaagcuagaagcuggguuuuaaauaauagcagagguuuggaaaaucauagagguugagagaagggaauuuccagcgaggaauugcauggacacaggcaugcagauagaagccaagaaauauauuuaggggacuuuacccaguuguauuggaguaaucauaagaagaaagcagagugagauaaaauaggaagguauuuuacacacagguuauuggccacauagaaaaccaggaccagagguuuggaccugaugccucaggcacuaggguaugagcauuugugagcugaggaaggucaguugcuccccucuaucugcagauucugcauucgugaagucaacucaacauggaucgaaaaguauuagaaaagaaaaaaugucgggugugguggccuccuccgauagucucagcuacaugggaggcauaggugggagaauucacugagcccaggaguugaagaccagccugggcaacauagugagacccugccuccagaaaaagaaagaaaaacaauaaaaaauaacaauacaacaacaaaaaaaauacaaccccgacccgcaguauaacaaccauuuacauugcauugauacuguauuagguacuauaaucuagagaugacuuaaaguguuugggaggauguguauagguuauaugcaaauacuacaccauuuuauaucaaggacuugagcaccaguggauuuuggugucuaugaauaccaaaugaagaaacuauuugcaaaggaaaaauuagaauccacaaagcuuagauauggcuccguguagaaagcauuggugucagaggcagccugauuuuuuggucuugcuuugacuggguaguaccauuaaagaaaaguuaugagguauaaacguguaagggaugggagaggcuaaugaaugugguuuucaauaugcugguuuuuaaagggaaauagcauauucaggcagaauuacucagccaguauuuggagauuuuagucagauuuagagacuggaaaacccuaaguguagauaugguacuugccguuggagauguugauagaagugacaugagggauugagauaaauaugaacaaauaaggagaggcagcaaggcugaacauccacccacccacuuauccaguauccauccacccauuuauccagucauccauccauucauccauccaguuauccauccacccaugcaucuccccacucaccuacccacccauucaccuacccauccauccacccaccgaccuguccacccacccaucuaucuaguuaucuauucacucacccaucuacauaucuauucacuuacccauccauccaccccacccauccaucuauccagucauguguccauccacccaccacccaucuauccaguuauccauccauccaccuacccaccuguccaucuaguuauccaucuacccaucuaugugguuacccauuugcucacccacccacccacccauguauccacuuacccauucauucacccaucuauacaguuauucauucacccauuuauccauccaccuaucuauccaguuacccauccacccaucuaugcauccauccauucauccauccauucacucaucugugcagacuuauguccaggaagggaagcugagcaggaacuaccucagagagguaggccugugaaggagaaccaaaagaagccuucgauuugggaaugagaaggacacuggugaugauuaagaaugaaauuucagaagaauaauggguguaucuaagauuaaaggaauuuggggggagauagugaugagauaccucauuaaauucuuuaauuucuccuuugaugugugaauguugagaagggacuuucuaaggauuugggaagcaugcuuaggauugcccccacuguggggcagaauaaauuuaguaucuuugacuaaagaacccagauccuuuaauacacuucuguccauugugagauaccaaaggagcuagccugugguauuucccaagcuaaugcgccagcagaauucuuuuucauuggagcgucuugcaggacuaacguucuguagaacauacucugggaucuagccagcuuucuggcuucucccacaacucauucuagaagacagagcuuuauagggaacugcccugaaaaagaagcuaucucacuugacuuucuuucuuuugugggagguccugacaagcuaauccugagggauuuagacagcugaguauaauccgagugugaaauugagggggagggugaucuggaguguccugaggcauuggaaaugagucagcgcuaaggugcgggaggcagcucaugucugucuacuuccacugagagcaaacuuggggcccuaaggaaggcugcucccaucuuaccgaagcaacagcauuugagauauguuaacuucuuguccuaaucauuuguauuacuuuuaugucuuaguuucuguuaauagaacugcaagauaaaagacuuuuacaaaacaaguacauauuuaagaggcaucagagaaucuaaucauuauugguaauucuugcuguugggaaauguguauuacuugcaugcacucguuuguaggagauuagggcaucgcucacaggcaggaugcaacagauagugguagcucacugggaccugcccgucaggacucucaggaggacacuccucauuggagcucugucggccuugugaaaaugaacgugcauucugucuuuugccugaaaagauuucagguuacacgcucacgguucaagcuucugauaauggcaguccacccagagucaacacgacgaccgugaacaucgauguguccgaugucaaugacaacgcgcccgucuucuccaggggaaacuacagugucauuauccaggugggcuucgagugccaaggugguccugggguucuuugaaaugagcuuuuccauuggccucuguugcuuuucuuucuuauccaaagguuucuuucuagaaaaaugggaaacguagaauucaagaagucgcuaucaguauuaaaagaugagcauuuuaaagauaaagccaagcuuuuaucucuuuccuuuccgugcuuugauuuuugagauauucucacuguucuaggauuccuaagagcuuauugcuuaaucagaccugcugccacuggugcuuuuccucugcccucuccuccccccuugaccuuccucuucccucuugcucuucuucuagcccccaauccuuccuucucgcuccaucuucuacuccacuuucuucaccccacucuucuuccucccuacuccuccucccuccaccucuucuccauuccauuccuccuccuucucuuccuccuccccacucuucccuccuccccacuccucccucccauuccuccccccucccuccaccucuucuccauuccuccuccuucucuuccuccuccccacuccccuccccacuccuccucuucccuccaccucuucuccacuccuccucuuccuccuccccacucugccucuuccccacuccaccuccucccccaaccuccucccuacuccacuuccuccccauuucacugucuccacucuuucuccuccucccuccaccucgucgccacuccuccucaucaccccuccuccucacuaccccuccuccucccccuucucacuuuuccuccucuugucaaccucuucucuuucuccuccccacuccuccucuuccuuccucucuuccucuuuuuuuuuuuuuuuuuuucugagauggaguuacacucauugcccaggcuagagugcaauggcacgaucucagcucacugcacccuccaccuccuggcuucaaacaguucuccugccucagccccaagugcugagauuacaggcacccaccaccacgcccggcuaauuuuuguauuuuuaguagagacgggguuucaccacguuggccaggcuggucucgaacuccugaccucaggugauccgcccgccucagccucccaaagugcugggaugacaggcgugagccaccgcgccuggccucgucucuuccuuuucuccuccaguccucuucuucuccuacacuccuccuccucucugcucuuccuccugucccccacuccuccucgugucugcuuccccuccucccucuuccuccucacacucccuuucuuaccauguuuccuucauccuccuuuuucuucccuuuucgcuacaccccuucuccuuucccuccuccucaccaccacacucccgucuccaccuuucuucucuuccuuucagauagagcagaaaggcuuuguuuuguauguauuuuauauuauagaaaacucaugugucugucccauauagauuuggcuguguuccaggauuuuuguuuaauuuuguuucuaaucuugugcaggaaaauaagccagugggcuucagcgugcugcagcugguaguaacagaugaggauucuucccauaacgguccacccuucuucuuuacuauuguaacuggaaaugaugagaaggcuuuugaaguuaacccgcaaggaguccuccugacaucaucugccaucaagaggaaggagaaagaucauuacuuacugcaggugaagguaugaauggcuuucuuugugguuugguuguggauucauagagaagagcugcuuggcgugguuccccucuucuauuugaacagcuuacauuucauacaaaaacaaacuuucauagaauugcugucuuuguuuuuugccauaccuuccauuuuuaucccgcuguguuugaaggagcucauuguugauucugucauagucauugacagagcuggguuucagugugaauuagugaagugcuauaaagaaauuuguccuuuucuuugauacguuucuuguguggagaaaugaguaucuaccaguuaguaauuuuuugggaacuugaguaauacaaauguuuuuauugaagaaguuauaaacagugccauagacaaaggugauuuuauuuuucuuuucuuguagguggcagauaauggaaagccucaguugucaucuuugacauacauugacauuaggguaauugaggagagcaucuauccgccugcgauuuugccccuggagauuuucaucaccucuucuggagaagaauacucagguggcgucauugggaagauccaugccacagaccaggacguguaugauacucuaaccuacagucucgacccucagauggacaaccuguucucuguuuccagcacagggggcaagcugauagcacacaaaaagcuagacauagggcaauaccuucucaaugucagcguaacagaugggaaguucacgacgguggccgacaucacagugcauaucagacaagucacacaggagauguugaaccacaccaucgcgauccgcuuugccaaccucacuccggaagaauucguuggugacuacuggcgcaacuuccagcgagcuuuacggaacauccugggugugaggaggaacgacauacagauuguuaguuugcaguccucugaaccucacccacaucuggacgucuuacuuuuuguagagaaaccagguagugcucagaucucaacaaaacaacuucugcacaagauuaacucuuccgugacugacauugaggaaaucauuggaguuaggauacugaauguauuccagaaacucugcgcgggacuggacugccccuggaaguucugcgaugaaaaggugucuguggaugaaagugugaugucaacacacagcacagccagacugaguuuugugacuccccgccaccacagggcagcggugugucucugcaaagguacugcacaugaguguaugaaagucggugucacagaugguuucagacggccuuugaagccuuugauggcuauacaugaaaggugauguucuugaaaugucuguuaauuaucuuuucccuuucuccccucuuugaaugaagagggaaggugcccaccuguccaccauggcugugaagaugauccgugcccugagggauccgaaugugugucugaucccugggaggagaaacacaccugugucugucccagcggcagguuuggucagugcccaggugagaguugaaugguuggguauacuuuuauuuuuaaaaaucgguuucauuguuucuuaccauuuucuucuuuauuggagucuaaaaauauugcaaaguauguuuauuguaagaagacagauguggagaugaauaaagaaugacaguaguaaguuuugcuuccucuuguuacagcacaccccuugguucauaguuggugucccuccuccugugucuucaaugauuauauagacauacagcuaacaacgcagugccauuauguagcaguuuaauuuuccuggaaauucaagagugaucauaucucacacaguucucucccuguugccuuuucccuccacuuagcaguaugguaaagagcaccuuucguaugguuccgagccaguaccuuuaaaccugauucuuuuugauagcuggauaauauuuucuagcauggcuguacuuauucaacauuguucuuauguguaaagauucgaguuguucucuuucuuucagauaaagaaaucuuuauacauguaucuuuacauacugaugcguucauuucuauacgguguauagauuauaaaacuagaauuugcuaucucaaacaucaaugacauuuuaaauuuuuuuguaucacuauauuaguuuuccaaaaagucguauuaauuuuuauuucucccaguuauguaugaagguuucacucuccauucuuuugacaucauugaacauuuucgauuauaaaacaaauuccccaccaucuauuuuaugggugugaagugauaucuaauuauuauuuuaauuugcauuucucuggcuacuuuaaaaguuuucaucucauuuguucauuuccuaucaguauugccucugcuguggccucuaccuguucauguuguuugauggucuggguuauuuguuucuuaguaucaauguguagaguuacuuguguauuaggaguauuaacauucacaguguugcaguuaccucugucuuuauaucauuuauauugauguuaucuuuugauuuguuaaguaugccucuugucauuuugaaauucaauuguuauuuagucaguucuacauaauuuuauguaacaguugccaucuguggagauugaugacauuugcaucuucuuuggggaauggggauuguuuuauuuugcuugagaagguuucuuaaaucaccuugaggcuauguauaacuauuuucugaaauuuucuucuaauaauuuuauacugaacauuuuuauauuuaaucuuucauuacuuuagaauucauuucucugugaugcagucgucaaauuuauucuuuccaaacagagagccagucaugcugggcuuuucauuaagcaaauagacguuuucccacagaauuggauaguaaaauguuaucaucuuaaauaaaacccuaaaucagucucaaggggugcaggggagucauacuuuaaaaaauaugcuuaaacuugguucugguuuauuuuuuccucugugugauucacagggaguucaucuaugacacugacuggaaacagcuacgugaaauaccgucugacggaaaaugaaaacaaauuagagaugaaacugaccaugaggcucagaacauauuccacgcaugcgguugucauguaugcucgaggaacugacuauagcaucuuggagguauguuucuccacagcguugcaucuuaguggaagacuuucaaaccauaaauuucauuuuauauucagauuguuaauuugcacagauaauaaaguaagugaaaugguugaauuccacauuuaaauaauucauugaugccuguacaaguuuuagacuuugugggaugaagagcucuuuuugcccugccaugacagagauuuagguccaugugacaguuaacauucaaacucuaggugaugccccauuuuaauaauguuggcugggugugguggcucacgccuguaaucccagcacuuugggaagcugaggcggguggaucacuugaggucaggaauuugagaccagccuggccagcauggcaaaaccugcucucuacuaaaaauacaaaaaauuagccagacuugguggcggacgccuguaauuccagcuacucaggaggcugaggcacgagaaucacuugaacaggggaggcagagguugcagugaguugagaucacgccacugcacuccagccugggcgacaagagugaaacugucucaaaaaacaaaaacuguuacaguuuauagagacauccuacauguguuucaaguguuauguaucuugcccaccuuuuuuaaaaacauuauucaguuuugacuuuugauauuaccuaaugcuuauguguucaguuaauaguuaauuauucgcuuccaugaugcuuuguggaugugcauuuuaacuugauauuccuaaaagacgcauuuuaaugauuuauacaguggacaaaugaaucugugcucuguaguacuuaaauguaaggccuaacuucuacccucacucccuaagcccucuccuguagauuugugaucaggugcucucauugaagguucuaugagaguaaugugaacagucauugcuuuuauccuagauucaucauggaaggcugcaguacaaguuugacuguggaaguggcccuggaauugucucuguucagagcauucaggucaaugaugggcaguggcacgcaguggcccuggaagugaauggaaacuaugcucgcuugguucuagaccaaguucauacugcaucgggcacagccccagggacucugaaaacccugaaccuggauaacuauguguuuuuugguggccacauccgucagcagggaacaaggcauggaagaaguccucaaguugguaaugguuucagggguuguauggacuccauuuauuugaaugggcaggagcucccuuuaaacagcaaacccagaagcuaugcacacaucgaagagucgguggauguaucuccaggcugcuuccugacggccacggaagacugcgccagcaacccuugccagaauggaggcguuugcaauccgucaccugcuggaggugggcuccguaauguugccaucuuuaaaaugcugcacguguguacauuuaaggggaagcuccccagguauuuuuuuauuuuuuucucuuuugauucagauaauuuugucagacacugcagucaguguuggaagcgagcagcaucccucauacgggggcagagcugggucugcugcccuucuggugcccaggcugcagguaccacggcucccacugcugagcgccugcagugcccucccagugcccgagcaggaggcaccucaagugacucagaacucuucuuuaacuccauagucaucggcccaggggaauuuagaauucguaccgcuuagcccuucuuuguuauuuguaucaccuuuuaucuaauggcucagcguagggggccugcuagauucuugcuggcaauaauaguugggaauaugauuuuccagaaggcccugaaucccuccugaaguguugccauaucugucugucuugaagcccuggcguagugggguacuuugugucuuuugcacccuggacuccuguuaggcccacuuaccaauaauaggguacaguuaggaaaaugacaguugucauaccaaauagagcuugguauaaugaacagagcaaaaauaauacugucauuaagugggauuuccaaagcuuugguuuucugcuguucucucagggagguauauuugcauucugugugcguagagugggccaggccauccccacagaaacacucucauuuauacugugcucauauuaguuacacguccaaaccagguuagcaaggaggccguccucauuuugucacuuagggaugaggcugagagaggugcuuuccugacaugcacucccauggucccgaagcaggaguaaaggaguauggcagcugugcccuggcuccuaaaggcccuggcccagggcaccacaguucuucauccugagaaaaacccacagccacgccagcuuuggaggggcggggaagcacugugcugcggugugcccucaaggcaggcaguuagaagaucugccacaccaccugucacuugacaaaguggagucgacauucuucguacugcuuugaacagaugugaugaucuccuuucuuaaaucuuuacauguuugagaggcugaggcaggaggaucacuugaggcuagaagugaggcagccugggcguuacagggaaaccccaucucuacaaaaacuuaaaaaaucagccaggcauguggcaugccucuaguuccagcuacucaggaggcugaggugggaggaucccugagcccgggaguuugaggaugcaaugagcugagauugcgccacugcacuccagccuggguggcagagcgagacccugucucaaaaaauaaaaauauugaaagguaauuuauagucuucaaagugcuuuucacauucauuauuuucucauuuaauccuuaaaugcuugugaauugcaaauaaauugagauguuaaguggugcugucuacguacauggucacucagguaaagaacuguauuuuccuccucuauaugugugaccuagugaucuuaaugcagauuaugaugaacuaaagcuaacugaguucucucuucaauucuggguguuuugguuauaccagcaguggaaggcuuguugauguagccaacuuuuuucccagagagagugagaauuuuacgagcuuuuacagaccucggagaauaaagauaaaaagcaauauaauuaagaccagguuucugagucauugagugauaggacuuuuuuguuccuuuuugccgauuuagguuauuacugcaaaugcagugccuuguacauagggacccacugugagauaagcgucaauccguguuccuccaagccaugccucuaugggggcacguguguugucgacaacggaggcuuuguuugccaguguagaggauuauauacuggucagagguauguguauuuuucuuaacuuucauaaucaauuguaguauaaaauucuuaaacauauaaugguacauguaaaaagucugcacguuaauuugcuaauguguucuguuuugcuuucuguuuugcuguauuuauuugcaauaggaucaugagguuuaugucuguuucuccuuacucuucaggugucagcuuaguccauacugcaaagaugaacccuguaagaauggcggaacaugcuuugacaguuuggauggcgccguuugucagugugauucggguuuuaggggagaaagguaaaugguuucuuucaaaauuuagguucauaccuuuucauagcgucauauugacuggcagaugcaacagaccuucagugauuugaacuacauuaugucagauuuugauaauccucauauuggccccuuauauaauuuauaaucuuuucacucuuuaaaaugaauuaucaagcagaugaauacaguauauauaauacuugaaaaaaacuaauguuuagccaaugggguugauguaauagucuguugauccuaggaaaauggccauuaauauuggcuugauauguuuccuucccaaauauacaucaaaagcaugcgaucacaugauugguuucuccacagaaggucuuuucucgugguugucgacguuacauuuuuuaguugucuuuuaucuggguuugaucuucacauagcucaucaaggagggauuagucuucagucucuaaggauugagccugacauacgcuggcguaugcuacagaggucucuccucauuccugacuuccuuggcaggugucagagugauaucgacgagugcucuggaaacccuugccugcacggggcccucugugagaacacgcacggcuccuaucacugcaacugcagccacgaguacaggggacgucacugcgaggaugcugcgcccaaccaguauguguccacgccguggaacauuggguuggcggaaggaauuggaaucguuguguuuguugcagggauauuuuuacugguggugguguuuguucucugccguaagaugauuagucggaaaaagaagcaucaggcugaaccuaaagacaagcaccugggacccgcuacggcuuucuugcaaagaccguauuuugauuccaagcuaaauaagaacauuuacucagacauaccaccccaggugccuguccggccuauuuccuacaccccgaguauuccaagugacucaagaaacaaucuggaccgaaauuccuucgaaggaucugcuaucccagagcaucccgaauucagcacuuuuaaccccgagucugugcacgggcaccgaaaagcaguggcggucugcagcguggcgccaaaccugccucccccacccccuucaaacuccccuucugacagcgacuccauccagaagccuagcugggacuuugacuaugacaguaagagccacuuuuucaucucacuaaagugucacuugagauaaacagugagguuacaaauucuguccagucaaaauguguguacucuucauuagagacaaguaugcucagacugaaauccguaugaugauuugaaacuuuuuuggaugucccgauugcuggguuagcauuguggcuuugauguuauuuuaauuaagaaauugaaucuagucauguuuaguuaauauucuggagagaucauuucauuuuauaauugauaaagguucucaucuauaauuuuuugaguuuauuaauaugucaaaaaaauaaucgggagcauuuucaugcuaggauuuuuaaaaauaugaccuggcgaaguggaaauauuuauauuagugaccuaacauauauuugaugcuuuuuucuuuuaaagcuguacauacuauuuuaaaacaaaauuuuagcagccuuuacugucuaaugauacccauaggcaugcuuaugggcgauuucuacucuaugaauaaucucuaagaugauguggaggucuuucugugcagggguuuuuuauuucuucguuugaguuuguaagguguuucuguuuuucuuucagucauucauuuauugaguaaaucucaggccaucguuggguaaugcauggugugucucaggauucagcggugaacaaaaccgucuuggcccauauacuuacuguuugucauccuuccuuuuagcaaaagugguggaucuugaucccugucuuuccaagaagccucuagaggaaaagccuucccagccauacagugcccgggaaagccugucugaagugcagucucugagcuccuuccaguccgaaucgugcgaugacaauggugaggcagcagugugcugcaacacugcgcuuugcuugcuuguuguguuacuguguuaucucacaauguagacgcacuaucuacccuuaaagccucaccauauuuucauuuuucuuggaccacuuuuaaacaauaccauacauacuugcaugaaugucugcuggggaaaauagccaaacuguucuuaaugaauagguguuugaacuugucaguaauagagaagaacauauucauugaaggaucugaucgacuaaucuuauauuggcuuuuuuucacaacaguuaauaucaccccaguuuuguggguuugucagaaaucuuccucgcaacuuucuuaaccacgcagcacgcacacaaacacacacucucucucacacacacacacacacacacccccucuaagaagagaugugauagucugaaauguucgauuucaguagcaccuuggguauuacaagguuuuauuugucuccucccccaaccccacugcggccccagcucccauuuggaucagagcguacugccagagcacaguuuaagagauugcuaguaaguuugauuauauuucuaaugaagaaaguuuaacagugggaucuuugccaccaguuauguugaucugguuucccuauaggguaaauugcauugauaacuagcuuugccauauuaacacauaccaguagagaaaaacgucaauauucaguaacacaauguaguuuuuaguggaaauuuuugaaucucagaauuaguaaguuuaaugauaauuuuuauuguauaaacguaauacguuuauuauuaaacauauuaauauguuauacauuucaaauauuuuauuggugggaaaagguaaccccacuaauaauuauucaauccagaguaauauaguccauaauacaucauauaguccauaaauccauauagucauuaucuauugcagucauuuuucaaacuaaagauagcuauaaguaugugcuaucauuucugauuucaaguauauauauauauauauauauauacuuucaaguauauauauauauacacacucuauuccuaaucaacacagguauauuuugauaccguauauaugguaucaaaauauaccuguguugauuaggaauaggguguauggacauagcuuugcuuguuaaaccaacaagauagaauuaugucuuuuaucaauuuuaauucuaagaaguuccuguuuccaguuuauguaauaauuuauaucuuggccccuaaaugcucuuuauaaauacauuucagaauuuuaucagcauuuucuuucuaguucuuguuguuggaacaucagucuucuuaauaauagucccagguggccgggcgcaguggcucacgccuguaaucccagcacuuugggaggugaaggcgggcggaucacaagguugggagaucgagaccguccuggcagugaaaccccgucucuacuaaaaauauaaaaaaaaucagccgggcgugguggugggcaccuguacucccagcuacuggggaggcugaggcaggagaauggccugagcccgggaguuguagcuugcagugagcugaggucacgccacugcacuccagccugggcgacagagcgagacucugucucaaaaaaaaaaauagucccaagugcuuucaauaaguuauggucaaauuaguuaugaaaacuagcuuccagauaguacaaugcagagaaaaaacauauauacaggaguguuuuuauuuuacucauuaccauaauguaauuaucaguuguaaacugaaagucugcugagagucuguuccugcgucguauucccgguuuuccagggccauuacagauuaccacaaacuuuguggccuaaaacaauguagacuuguguugcugucauucuguagcuuagaagcccaaccccugugucucacagggcuuaagucaugcgaucaguagggcugcauugccuucugcagcucgagggaagaaccuguuuuccuuccuuuccugguuuuuagaggcugcccacauucuuuggcucuugguuucuuccaucucagagacagcaacacaguguuucauugaccacccuucugucagcagagcuccccccagccguaacugggaacgccucugugcagaaaaguuacccuuaugauuacacugggcccacccagguaauccagggaaaucccucaucucaauuuccuuaucugaaccgcgucaacaaagucccuuuugccauguauagugacauauucacaggcuccugggauuaggacguggacuauuugagggccagccuucugccuaccacaugcguacauauuuaccuuggcauaguuauuuuaaaacaaucugauacacaaaugaaaagggaauuuacacaggaaacagacggacagagucuccuccuauacucguacauuagcucaccagcgauuaguccaucugcaaacagacgagaaauuugcagggaaagcaaucagaacagggacaaaaacauucuuguuuuagauugcauauguuucuccuucaauuucuuuuuuuugggggacaaugugugagugauuaagcagccggaagaguggcgaaccacagacuguagucuuggaaugucgagucuugccuguaagauguuaaaauaagaaucguuuuggccuggcaugaugcauaauuguaauugugaaaaaauuuaaagcuaaaaguuuuuuuguuuaaauuccaauaaaauauguuuacguuauuccuuugauuaauaauaacaaauauauagcucgauuaaaaaagucucugagacacacagcuaacagugaggagaccacgcaucauuaugugguuguauuaaagcacucaucgguuggaaucugagguagaaaugguauaauacaaaacuuuauuucaugcacuguuuucuaacuaacugaagauguuccuaauugacugcuuuuguaccuuuuugcaagcuuccauagugaccguaaugcaccuugucaaugcugugguugacacggugagcacagaagguacaguuguaagugcucgugcuugugucugugucuugcagcagccgugucguagagcucggccgcauugcuauugcaaugguaggaaaaaacaguuugugguuuugaggggguugaguccuuuuauuuuaugcagguguguauauacguaauaugagugcuuugcaaaaaauaucucaauguauguuaugucuuuguuccuuuuuaccauucauagugauuuacaugagaucuggagagcuuaucuguagguggugcaaucaagaaaaaguucagaaguaauuuuaccuaaaauuuuuuugaaacaaaaauucuucuucguauguacaggaauaagacuugaauaauguaaagcuuucauaauuaaccuguaacugacucuucacuuuugguuuuucccugaguaugaucaaagaaaaggguguagagcaugguaaaagaauauuuucauauuugguuuagugaaaauuauuuaaugugaagcuuuaucugcucagaguuguaagaaaggacauugagcaccuuccccaaauuauuuuaaauuaaaauagcccuuuauuagugcacugaaauucaucacauggggaagacacaggcuaguacuuuucaaacuguaaugugaaucagaucaucuggagggcuguuaaaagcccaauugcugguucucagcaccagcauuucugauccaacaggucuggguugggacuuuagaauuugcauuuuucaccaguucccagguagcucugauggugccggucuagagaucccacucgagaacugcuuacagaggccaucgaguacacagacgucaucauagaguucgggggauccuuuaugcuaggacaugaugcugucaagguucaggaggagggaggauagcucugggccccauuugcuaucaggcagaagaggcuuagauacuccaguguucaugguuauaguuacugaugacgccuacacuucuuuuccuaagaaguaccauguuuucacugggcaaaucagaaacauaccuguauuuugucuagugaaguuuuaguguuaaacugaugaccuucagcauuuuaaauauuauugaagcuuauagaagcagaauuucaacaguuccuucauugcagucuccuucauugacaaauauuuuuuggcauauccaagaagugcacauggaauuuaaaguugaaagcuauuacuagugccuacguaacaaaaguuguugaucuuuuuuuguuuaaaggaauugcugcuuuuguuacuagacuuaaaaaugauucuguagauacauguuaccuaaaugccggcguauucauguuuuagagacaccacagucuuuuaaaauuacugaaauuucuagaagugaacuaucaaucaaauauuugucccaaauuauaacacuguugaaugcauagaaagccuuguuuaaaaaaucacggaugugaccguuuuucugcugugaugucuacuuucacaguuauugauaguuucuaacagugcuuaaccugcaugauccuguuuaauccucauaacaacucuaacggauuuucaccccauuucaaagagagaaccugaagguuagccagggccugggcaggcgucucauggcccuaacugauagugggauuuacaugcguuugguuacacuuccugcugggcuucuguguauagaugcggggcccuggcagggcaaguguaauuacagacaugggguaaguguagccguggucucuuuagggaauggcucacagugucaauauuaaagcauauucaaaauacauacaguuuggagagaucuucagcuuguacaucugucuuuaaguaucuaaguuugccuaugaauuccucugaauuuaauguccuuugaaguugcagugugcuauaaagugugugcauuauguagcuguagauguauuuggauuaucaccuauguaaucugaucaguuuauauuuuauuagagccuguuuguuuuguuuucauuauuccuaaggaaauucuguguuuucaggcugugauugucagaaacaaggaaaagaaaguaauauuugaguuuucuggccaaauuucugguuccucauuccgcagucacuuuccuccacuuccauauuccauuuuauuugugguacauacauuucucagccauuuggaauugucauagauacuggcguaaggacaugcuguauggcugauugggccucuguaagcaguuuucauuguucuguguacuuaccuuuauugccuuuucagccgacuguuuuaauuacaaauguuuucuuuuuuuucuacucugccaccaaaagaaucuuuggcugcuccugaccucagcaaaccaagaggugacuuaugcaugccaguuauucauugauacucacuaaaaacaaugggucaagccuugccccagugcugacugacuacgcugggucgcccaguguuugcagcaguaacuaaguacacggcugcaugugugugcgcauugcauuugaagcacggauugccuaaccuucucccgccucuccaaggauuuuuuaaauccuaaggaggaaaaaaaaaaaacuauuccaaaauuggaaguuuuuuuuuaaaauaguggugcuuuauauagucuaaaaggaucacaguccuuuuggaaguaacacagauugauuguuacaguguaucagaggcuguguuauaaucuugcaacgcuuguucaauuguauuuugcuugaauuggcaugcuuugauacauaccuauauuaaguuaauuuguugucugaggguuaaugaaaaauaguaauuuuaauauuaaacuugcuacauuauuaugaaggaagcuuauuuucuaaacuuuagcauguuaaagguuacuuuuauuacuuuaaaaaguugcauuggcugggccugauggcucacaccuguaaucccagcacuucgggaagcugaauuggcaagauuguuuguggccaggaguuuaagaccagccugggcaacauagugagacccugucucuauaaaaaauagaaaugcaaaauuuuuuuaaguugcauuaaucaguauuuuuuuaaugagaaguagugcagaucaagugacacuggauauuucacuaauguccugagacuggaucaguacucuucuuccuacagagcaguggguucuacagaagaaaagccagaaggaugguuagaaucauuuguagaaaaauguauauaauuuagaugcuagcaucccauuucucuuaggacuccuuuuguuuccuugaauguuaguugcguacauaaaacuguaaguccacauuuuagaacuagagccuaguucauaggggucuuuaaacuggaguggguugggggaugucuucaaagcaaagacgaggaauuuccaguggugaacuuugaaugaaggcauaaaugcgguugcaucuuugugucuuugauacacugagcucucuuuccauggcacaaaagcuuaggagaaaacacacugacaucuguuuucuuuuccaccaaggguaucacugggauacaucagauuggaugccaagcguuccucugccggacauacaagaguuccccaacuaugaggugauugaugagcagacaccccuguacucagcagauccaaacgccaucgauacggacuauuacccuggaggcuacgacaucgaaagugauuuuccuccacccccagaagacuuccccgcagcugaugagcuaccaccguuaccgcccgaauucagcaaucaguuugaauccauccacccuccuagagacaugccugccgcggguagcuuggguucuucaucaagaaaccggcagagguucaacuugaaucaguauuugcccaauuuuuauccccucgauaugucugaaccucaaacaaaaggcacuggugagaauaguacuuguagagaaccccaugccccuuacccgccaggguaucaaagacacuucgaggcgcccgcugucgagagcaugcccaugucuguguacgccuccaccgccuccugcucugacgugucagccugcugcgaaguggaguccgaggucaugaugagugacuaugagagcggggacgacggccacuucgaagaggugacgaucccgccccuggauucccagcagcacacggaagucugacucucaacuccccccaaagugccugacuuuagugaaccuagaggugaugugaguaauccgcgcuguucuuugcagcagugcuuccaagcuuuuuuuggugagccgaaugggcauggcugcgcuggauccugcgccucuggacgugcuagccauuuccagugucccaacuacugucaucgugagguuuucaucggcugugccauuucccaacgucuuuugggauuuacaucugucuguguuaaaauaaucaaacgaaaaaucaguccuguguugucagcaugauucauguauuuauauagauuugauuauuuuaauuuuccugucucuuuuuuuuguaaauuuuauguacagauuugauuuuucauaguuuuaacuagauuuccaagauauuuugugcauuuguuucaacugaauuuugguggugucagugccauuaucuagcacccugauuuuuuuuuuuuuacuauaaccaggguuucauucugucuuuuuccacugaagugugacauuuuguuaguacauuucaguguagucauucauuucuagcuguacauaggaugaaggagagaucagauacaugaacaugucuuacauggguugcuguauuuagaauuauaaacauuuuucauuauuggaaaguguaacggggaccuucugcauaccuguuuagaaccaaaaccaccaugacacaguuuuuauagugucuguauauuugugaugcaauggucuuguaaagguuuuuaaugaaaacuaccauuagccagucuuucuuacugacaauaaauuauuaauaaaauacuugagcuuua

SEQ ID NO: 21446 - RNA, 122052 nt, Homo sapiens
uaaagcucaaguauuuuauuaauaauuuauugucaguaagaaagacuggcuaaugguaguuuucauuaaaaaccuuuacaagaccauugcaucacaaauauacagacacuauaaaaacugugucauggugguuuugguucuaaacagguaugcagaagguccccguuacacuuuccaauaaugaaaaauguuuauaauucuaaauacagcaacccauguaagacauguucauguaucugaucucuccuucauccuauguacagcuagaaaugaaugacuacacugaaauguacuaacaaaaugucacacuucaguggaaaaagacagaaugaaacccugguuauaguaaaaaaaaaaaaaucagggugcuagauaauggcacugacaccaccaaaauucaguugaaacaaaugcacaaaauaucuuggaaaucuaguuaaaacuaugaaaaaucaaaucuguacauaaaauuuacaaaaaaaagagacaggaaaauuaaaauaaucaaaucuauauaaauacaugaaucaugcugacaacacaggacugauuuuucguuugauuauuuuaacacagacagauguaaaucccaaaagacguugggaaauggcacagccgaugaaaaccucacgaugacaguaguugggacacuggaaauggcuagcacguccagaggcgcaggauccagcgcagccaugcccauucggcucaccaaaaaaagcuuggaagcacugcugcaaagaacagcgcggauuacucacaucaccucuagguucacuaaagucaggcacuuuggggggaguugagagucagacuuccgugugcugcugggaauccaggggcgggaucgucaccucuucgaaguggccgucguccccgcucucauagucacucaucaugaccucggacuccacuucgcagcaggcugacacgucagagcaggaggcgguggaggcguacacagacaugggcaugcucucgacagcgggcgccucgaagugucuuugauacccuggcggguaaggggcaugggguucucuacaaguacuauucucaccagugccuuuuguuugagguucagacauaucgaggggauaaaaauugggcaaauacugauucaaguugaaccucugccgguuucuugaugaagaacccaagcuacccgcggcaggcaugucucuaggaggguggauggauucaaacugauugcugaauucgggcgguaacggugguagcucaucagcugcggggaagucuucuggggguggaggaaaaucacuuucgaugucguagccuccaggguaauaguccguaucgauggcguuuggaucugcugaguacaggggugucugcucaucaaucaccucauaguuggggaacucuuguauguccggcagaggaacgcuuggcauccaaucugauguaucccagugauacccuugguggaaaagaaaacagaugucaguguguuuucuccuaagcuuuugugccauggaaagagagcucaguguaucaaagacacaaagaugcaaccgcauuuaugccuucauucaaaguucaccacuggaaauuccucgucuuugcuuugaagacaucccccaacccacuccaguuuaaagaccccuaugaacuaggcucuaguucuaaaauguggacuuacaguuuuauguacgcaacuaacauucaaggaaacaaaaggaguccuaagagaaaugggaugcuagcaucuaaauuauauacauuuuucuacaaaugauucuaaccauccuucuggcuuuucuucuguagaacccacugcucuguaggaagaagaguacugauccagucucaggacauuagugaaauauccagugucacuugaucugcacuacuucucauuaaaaaaauacugauuaaugcaacuuaaaaaaauuuugcauuucuauuuuuuauagagacagggucucacuauguugcccaggcuggucuuaaacuccuggccacaaacaaucuugccaauucagcuucccgaagugcugggauuacaggugugagccaucaggcccagccaaugcaacuuuuuaaaguaauaaaaguaaccuuuaacaugcuaaaguuuagaaaauaagcuuccuucauaauaauguagcaaguuuaauauuaaaauuacuauuuuucauuaacccucagacaacaaauuaacuuaauauagguauguaucaaagcaugccaauucaagcaaaauacaauugaacaagcguugcaagauuauaacacagccucugauacacuguaacaaucaaucuguguuacuuccaaaaggacugugauccuuuuagacuauauaaagcaccacuauuuuaaaaaaaaacuuccaauuuuggaauaguuuuuuuuuuuuccuccuuaggauuuaaaaaauccuuggagaggcgggagaagguuaggcaauccgugcuucaaaugcaaugcgcacacacaugcagccguguacuuaguuacugcugcaaacacugggcgacccagcguagucagucagcacuggggcaaggcuugacccauuguuuuuagugaguaucaaugaauaacuggcaugcauaagucaccucuugguuugcugaggucaggagcagccaaagauucuuuugguggcagaguagaaaaaaaagaaaacauuuguaauuaaaacagucggcugaaaaggcaauaaagguaaguacacagaacaaugaaaacugcuuacagaggcccaaucagccauacagcauguccuuacgccaguaucuaugacaauuccaaauggcugagaaauguauguaccacaaauaaaauggaauauggaaguggaggaaagugacugcggaaugaggaaccagaaauuuggccagaaaacucaaauauuacuuucuuuuccuuguuucugacaaucacagccugaaaacacagaauuuccuuaggaauaaugaaaacaaaacaaacaggcucuaauaaaauauaaacugaucagauuacauaggugauaauccaaauacaucuacagcuacauaaugcacacacuuuauagcacacugcaacuucaaaggacauuaaauucagaggaauucauaggcaaacuuagauacuuaaagacagauguacaagcugaagaucucuccaaacuguauguauuuugaauaugcuuuaauauugacacugugagccauucccuaaagagaccacggcuacacuuaccccaugucuguaauuacacuugcccugccagggccccgcaucuauacacagaagcccagcaggaaguguaaccaaacgcauguaaaucccacuaucaguuagggccaugagacgccugcccaggcccuggcuaaccuucagguucucucuuugaaauggggugaaaauccguuagaguuguuaugaggauuaaacaggaucaugcagguuaagcacuguuagaaacuaucaauaacugugaaaguagacaucacagcagaaaaacggucacauccgugauuuuuuaaacaaggcuuucuaugcauucaacaguguuauaauuugggacaaauauuugauugauaguucacuucuagaaauuucaguaauuuuaaaagacuguggugucucuaaaacaugaauacgccggcauuuagguaacauguaucuacagaaucauuuuuaagucuaguaacaaaagcagcaauuccuuuaaacaaaaaaagaucaacaacuuuuguuacguaggcacuaguaauagcuuucaacuuuaaauuccaugugcacuucuuggauaugccaaaaaauauuugucaaugaaggagacugcaaugaaggaacuguugaaauucugcuucuauaagcuucaauaauauuuaaaaugcugaaggucaucaguuuaacacuaaaacuucacuagacaaaauacagguauguuucugauuugcccagugaaaacaugguacuucuuaggaaaagaaguguaggcgucaucaguaacuauaaccaugaacacuggaguaucuaagccucuucugccugauagcaaauggggcccagagcuauccucccuccuccugaaccuugacagcaucauguccuagcauaaaggaucccccgaacucuaugaugacgucuguguacucgauggccucuguaagcaguucucgagugggaucucuagaccggcaccaucagagcuaccugggaacuggugaaaaaugcaaauucuaaagucccaacccagaccuguuggaucagaaaugcuggugcugagaaccagcaauugggcuuuuaacagcccuccagaugaucugauucacauuacaguuugaaaaguacuagccugugucuuccccaugugaugaauuucagugcacuaauaaagggcuauuuuaauuuaaaauaauuuggggaaggugcucaauguccuuucuuacaacucugagcagauaaagcuucacauuaaauaauuuucacuaaaccaaauaugaaaauauucuuuuaccaugcucuacacccuuuucuuugaucauacucagggaaaaaccaaaagugaagagucaguuacagguuaauuaugaaagcuuuacauuauucaagucuuauuccuguacauacgaagaagaauuuuuguuucaaaaaaauuuuagguaaaauuacuucugaacuuuuucuugauugcaccaccuacagauaagcucuccagaucucauguaaaucacuaugaaugguaaaaaggaacaaagacauaacauacauugagauauuuuuugcaaagcacucauauuacguauauacacaccugcauaaaauaaaaggacucaacccccucaaaaccacaaacuguuuuuuccuaccauugcaauagcaaugcggccgagcucuacgacacggcugcugcaagacacagacacaagcacgagcacuuacaacuguaccuucugugcucaccgugucaaccacagcauugacaaggugcauuacggucacuauggaagcuugcaaaaagguacaaaagcagucaauuaggaacaucuucaguuaguuagaaaacagugcaugaaauaaaguuuuguauuauaccauuucuaccucagauuccaaccgaugagugcuuuaauacaaccacauaaugaugcguggucuccucacuguuagcugugugucucagagacuuuuuuaaucgagcuauauauuuguuauuauuaaucaaaggaauaacguaaacauauuuuauuggaauuuaaacaaaaaaacuuuuagcuuuaaauuuuuucacaauuacaauuaugcaucaugccaggccaaaacgauucuuauuuuaacaucuuacaggcaagacucgacauuccaagacuacagucugugguucgccacucuuccggcugcuuaaucacucacacauugucccccaaaaaaaagaaauugaaggagaaacauaugcaaucuaaaacaagaauguuuuugucccuguucugauugcuuucccugcaaauuucucgucuguuugcagauggacuaaucgcuggugagcuaauguacgaguauaggaggagacucuguccgucuguuuccuguguaaauucccuuuucauuuguguaucagauuguuuuaaaauaacuaugccaagguaaauauguacgcaugugguaggcagaaggcuggcccucaaauaguccacguccuaaucccaggagccugugaauaugucacuauacauggcaaaagggacuuuguugacgcgguucagauaaggaaauugagaugagggauuucccuggauuaccugggugggcccaguguaaucauaaggguaacuuuucugcacagaggcguucccaguuacggcuggggggagcucugcugacagaaggguggucaaugaaacacuguguugcugucucugagauggaagaaaccaagagccaaagaaugugggcagccucuaaaaaccaggaaaggaaggaaaacagguucuucccucgagcugcagaaggcaaugcagcccuacugaucgcaugacuuaagcccugugagacacagggguugggcuucuaagcuacagaaugacagcaacacaagucuacauuguuuuaggccacaaaguuugugguaaucuguaauggcccuggaaaaccgggaauacgacgcaggaacagacucucagcagacuuucaguuuacaacugauaauuacauuaugguaaugaguaaaauaaaaacacuccuguauauauguuuuuucucugcauuguacuaucuggaagcuaguuuucauaacuaauuugaccauaacuuauugaaagcacuugggacuauuuuuuuuuuugagacagagucucgcucugucgcccaggcuggagugcaguggcgugaccucagcucacugcaagcuacaacucccgggcucaggccauucuccugccucagccuccccaguagcugggaguacaggugcccaccaccacgcccggcugauuuuuuuuauauuuuuaguagagacgggguuucacugccaggacggucucgaucucccaaccuugugauccgcccgccuucaccucccaaagugcugggauuacaggcgugagccacugcgcccggccaccugggacuauuauuaagaagacugauguuccaacaacaagaacuagaaagaaaaugcugauaaaauucugaaauguauuuauaaagagcauuuaggggccaagauauaaauuauuacauaaacuggaaacaggaacuucuuagaauuaaaauugauaaaagacauaauucuaucuuguugguuuaacaagcaaagcuauguccauacacccuauuccuaaucaacacagguauauuuugauaccauauauacgguaucaaaauauaccuguguugauuaggaauagaguguguauauauauauauacuugaaaguauauauauauauauauauauauacuugaaaucagaaaugauagcacauacuuauagcuaucuuuaguuugaaaaaugacugcaauagauaaugacuauauggauuuauggacuauaugauguauuauggacuauauuacucuggauugaauaauuauuagugggguuaccuuuucccaccaauaaaauauuugaaauguauaacauauuaauauguuuaauaauaaacguauuacguuuauacaauaaaaauuaucauuaaacuuacuaauucugagauucaaaaauuuccacuaaaaacuacauuguguuacugaauauugacguuuuucucuacugguauguguuaauauggcaaagcuaguuaucaaugcaauuuacccuauagggaaaccagaucaacauaacugguggcaaagaucccacuguuaaacuuucuucauuagaaauauaaucaaacuuacuagcaaucucuuaaacugugcucuggcaguacgcucugauccaaaugggagcuggggccgcagugggguugggggaggagacaaauaaaaccuuguaauacccaaggugcuacugaaaucgaacauuucagacuaucacaucucuucuuagagggggugugugugugugugugugugagagagaguguguguuugugugcgugcugcgugguuaagaaaguugcgaggaagauuucugacaaacccacaaaacuggggugauauuaacuguugugaaaaaaagccaauauaagauuagucgaucagauccuucaaugaauauguucuucucuauuacugacaaguucaaacaccuauucauuaagaacaguuuggcuauuuuccccagcagacauucaugcaaguauguaugguauuguuuaaaagugguccaagaaaaaugaaaauauggugaggcuuuaaggguagauagugcgucuacauugugagauaacacaguaacacaacaagcaagcaaagcgcaguguugcagcacacugcugccucaccauugucaucgcacgauucggacuggaaggagcucagagacugcacuucagacaggcuuucccgggcacuguauggcugggaaggcuuuuccucuagaggcuucuuggaaagacagggaucaagauccaccacuuuugcuaaaaggaaggaugacaaacaguaaguauaugggccaagacgguuuuguucaccgcugaauccugagacacaccaugcauuacccaacgauggccugagauuuacucaauaaaugaaugacugaaagaaaaacagaaacaccuuacaaacucaaacgaagaaauaaaaaaccccugcacagaaagaccuccacaucaucuuagagauuauucauagaguagaaaucgcccauaagcaugccuauggguaucauuagacaguaaaggcugcuaaaauuuuguuuuaaaauaguauguacagcuuuaaaagaaaaaagcaucaaauauauguuaggucacuaauauaaauauuuccacuucgccaggucauauuuuuaaaaauccuagcaugaaaaugcucccgauuauuuuuuugacauauuaauaaacucaaaaaauuauagaugagaaccuuuaucaauuauaaaaugaaaugaucucuccagaauauuaacuaaacaugacuagauucaauuucuuaauuaaaauaacaucaaagccacaaugcuaacccagcaaucgggacauccaaaaaaguuucaaaucaucauacggauuucagucugagcauacuugucucuaaugaagaguacacacauuuugacuggacagaauuuguaaccucacuguuuaucucaagugacacuuuagugagaugaaaaaguggcucuuacugucauagucaaagucccagcuaggcuucuggauggagucgcugucagaaggggaguuugaagggggugggggaggcagguuuggcgccacgcugcagaccgccacugcuuuucggugcccgugcacagacucgggguuaaaagugcugaauucgggaugcucugggauagcagauccuucgaaggaauuucgguccagauuguuucuugagucacuuggaauacucgggguguaggaaauaggccggacaggcaccuggggugguaugucugaguaaauguucuuauuuagcuuggaaucaaaauacggucuuugcaagaaagccguagcgggucccaggugcuugucuuuagguucagccugaugcuucuuuuuccgacuaaucaucuuacggcagagaacaaacaccaccaccaguaaaaauaucccugcaacaaacacaacgauuccaauuccuuccgccaacccaauguuccacggcguggacacauacugguugggcgcagcauccucgcagugacguccccuguacucguggcugcaguugcagugauaggagccgugcguguucucacagagggccccgugcaggcaaggguuuccagagcacucgucgauaucacucugacaccugccaaggaagucaggaaugaggagagaccucuguagcauacgccagcguaugucaggcucaauccuuagagacugaagacuaaucccuccuugaugagcuaugugaagaucaaacccagauaaaagacaacuaaaaaauguaacgucgacaaccacgagaaaagaccuucuguggagaaaccaaucaugugaucgcaugcuuuugauguauauuugggaaggaaacauaucaagccaauauuaauggccauuuuccuaggaucaacagacuauuacaucaaccccauuggcuaaacauuaguuuuuuucaaguauuauauauacuguauucaucugcuugauaauucauuuuaaagagugaaaagauuauaaauuauauaaggggccaauaugaggauuaucaaaaucugacauaauguaguucaaaucacugaaggucuguugcaucugccagucaauaugacgcuaugaaaagguaugaaccuaaauuuugaaagaaaccauuuaccuuucuccccuaaaacccgaaucacacugacaaacggcgccauccaaacugucaaagcauguuccgccauucuuacaggguucaucuuugcaguauggacuaagcugacaccugaagaguaaggagaaacagacauaaaccucaugauccuauugcaaauaaauacagcaaaacagaaagcaaaacagaacacauuagcaaauuaacgugcagacuuuuuacauguaccauuauauguuuaagaauuuuauacuacaauugauuaugaaaguuaagaaaaauacacauaccucugaccaguauauaauccucuacacuggcaaacaaagccuccguugucgacaacacacgugcccccauagaggcauggcuuggaggaacacggauugacgcuuaucucacagugggucccuauguacaaggcacugcauuugcaguaauaaccuaaaucggcaaaaaggaacaaaaaaguccuaucacucaaugacucagaaaccuggucuuaauuauauugcuuuuuaucuuuauucuccgaggucuguaaaagcucguaaaauucucacucucucugggaaaaaaguuggcuacaucaacaagccuuccacugcugguauaaccaaaacacccagaauugaagagagaacucaguuagcuuuaguucaucauaaucugcauuaagaucacuaggucacacauauagaggaggaaaauacaguucuuuaccugagugaccauguacguagacagcaccacuuaacaucucaauuuauuugcaauucacaagcauuuaaggauuaaaugagaaaauaaugaaugugaaaagcacuuugaagacuauaaauuaccuuucaauauuuuuauuuuuugagacagggucucgcucugccacccaggcuggagugcaguggcgcaaucucagcucauugcauccucaaacucccgggcucagggauccucccaccucagccuccugaguagcuggaacuagaggcaugccacaugccuggcugauuuuuuaaguuuuuguagagaugggguuucccuguaacgcccaggcugccucacuucuagccucaagugauccuccugccucagccucucaaacauguaaagauuuaagaaaggagaucaucacaucuguucaaagcaguacgaagaaugucgacuccacuuugucaagugacaggugguguggcagaucuucuaacugccugccuugagggcacaccgcagcacagugcuuccccgccccuccaaagcuggcguggcuguggguuuuucucaggaugaagaacuguggugcccugggccagggccuuuaggagccagggcacagcugccauacuccuuuacuccugcuucgggaccaugggagugcaugucaggaaagcaccucucucagccucaucccuaagugacaaaaugaggacggccuccuugcuaaccugguuuggacguguaacuaauaugagcacaguauaaaugagaguguuucuguggggauggccuggcccacucuacgcacacagaaugcaaauauaccucccugagagaacagcagaaaaccaaagcuuuggaaaucccacuuaaugacaguauuauuuuugcucuguucauuauaccaagcucuauuugguaugacaacugucauuuuccuaacuguacccuauuauugguaagugggccuaacaggaguccagggugcaaaagacacaaaguaccccacuacgccagggcuucaagacagacagauauggcaacacuucaggagggauucagggccuucuggaaaaucauauucccaacuauuauugccagcaagaaucuagcaggcccccuacgcugagccauuagauaaaaggugauacaaauaacaaagaagggcuaagcgguacgaauucuaaauuccccugggccgaugacuauggaguuaaagaagaguucugagucacuugaggugccuccugcucgggcacugggagggcacugcaggcgcucagcagugggagccgugguaccugcagccugggcaccagaagggcagcagacccagcucugcccccguaugagggaugcugcucgcuuccaacacugacugcagugucugacaaaauuaucugaaucaaaagagaaaaaaauaaaaaaauaccuggggagcuuccccuuaaauguacacacgugcagcauuuuaaagauggcaacauuacggagcccaccuccagcaggugacggauugcaaacgccuccauucuggcaaggguugcuggcgcagucuuccguggccgucaggaagcagccuggagauacauccaccgacucuucgaugugugcauagcuucuggguuugcuguuuaaagggagcuccugcccauucaaauaaauggaguccauacaaccccugaaaccauuaccaacuugaggacuucuuccaugccuuguucccugcugacggauguggccaccaaaaaacacauaguuauccagguucaggguuuucagagucccuggggcugugcccgaugcaguaugaacuuggucuagaaccaagcgagcauaguuuccauucacuuccagggccacugcgugccacugcccaucauugaccugaaugcucugaacagagacaauuccagggccacuuccacagucaaacuuguacugcagccuuccaugaugaaucuaggauaaaagcaaugacuguucacauuacucucauagaaccuucaaugagagcaccugaucacaaaucuacaggagagggcuuagggagugaggguagaaguuaggccuuacauuuaaguacuacagagcacagauucauuuguccacuguauaaaucauuaaaaugcgucuuuuaggaauaucaaguuaaaaugcacauccacaaagcaucauggaagcgaauaauuaacuauuaacugaacacauaagcauuagguaauaucaaaagucaaaacugaauaauguuuuuaaaaaaggugggcaagauacauaacacuugaaacacauguaggaugucucuauaaacuguaacaguuuuuguuuuuugagacaguuucacucuugucgcccaggcuggagugcaguggcgugaucucaacucacugcaaccucugccuccccuguucaagugauucucgugccucagccuccugaguagcuggaauuacaggcguccgccaccaagucuggcuaauuuuuuguauuuuuaguagagagcagguuuugccaugcuggccaggcuggucucaaauuccugaccucaagugauccacccgccucagcuucccaaagugcugggauuacaggcgugagccaccacacccagccaacauuauuaaaauggggcaucaccuagaguuugaauguuaacugucacauggaccuaaaucucugucauggcagggcaaaaagagcucuucaucccacaaagucuaaaacuuguacaggcaucaaugaauuauuuaaauguggaauucaaccauuucacuuacuuuauuaucugugcaaauuaacaaucugaauauaaaaugaaauuuaugguuugaaagucuuccacuaagaugcaacgcuguggagaaacauaccuccaagaugcuauagucaguuccucgagcauacaugacaaccgcaugcguggaauauguucugagccucauggucaguuucaucucuaauuuguuuucauuuuccgucagacgguauuucacguagcuguuuccagucagugucauagaugaacucccugugaaucacacagaggaaaaaauaaaccagaaccaaguuuaagcauauuuuuuaaaguaugacuccccugcaccccuugagacugauuuaggguuuuauuuaagaugauaacauuuuacuauccaauucugugggaaaacgucuauuugcuuaaugaaaagcccagcaugacuggcucucuguuuggaaagaauaaauuugacgacugcaucacagagaaaugaauucuaaaguaaugaaagauuaaauauaaaaauguucaguauaaaauuauuagaagaaaauuucagaaaauaguuauacauagccucaaggugauuuaagaaaccuucucaagcaaaauaaaacaauccccauuccccaaagaagaugcaaaugucaucaaucuccacagauggcaacuguuacauaaaauuauguagaacugacuaaauaacaauugaauuucaaaaugacaagaggcauacuuaacaaaucaaaagauaacaucaauauaaaugauauaaagacagagguaacugcaacacugugaauguuaauacuccuaauacacaaguaacucuacacauugauacuaagaaacaaauaacccagaccaucaaacaacaugaacagguagaggccacagcagaggcaauacugauaggaaaugaacaaaugagaugaaaacuuuuaaaguagccagagaaaugcaaauuaaaauaauaauuagauaucacuucacacccauaaaauagaugguggggaauuuguuuuauaaucgaaaauguucaaugaugucaaaagaauggagagugaaaccuucauacauaacugggagaaauaaaaauuaauacgacuuuuuggaaaacuaauauagugauacaaaaaaauuuaaaaugucauugauguuugagauagcaaauucuaguuuuauaaucuauacaccguauagaaaugaacgcaucaguauguaaagauacauguauaaagauuucuuuaucugaaagaaagagaacaacucgaaucuuuacacauaagaacaauguugaauaaguacagccaugcuagaaaauauuauccagcuaucaaaaagaaucagguuuaaagguacuggcucggaaccauacgaaaggugcucuuuaccauacugcuaaguggagggaaaaggcaacagggagagaacugugugagauaugaucacucuugaauuuccaggaaaauuaaacugcuacauaauggcacugcguuguuagcuguaugucuauauaaucauugaagacacaggaggagggacaccaacuaugaaccaaggggugugcuguaacaagaggaagcaaaacuuacuacugucauucuuuauucaucuccacaucugucuucuuacaauaaacauacuuugcaauauuuuuagacuccaauaaagaagaaaaugguaagaaacaaugaaaccgauuuuuaaaaauaaaaguauacccaaccauucaacucucaccugggcacugaccaaaccugccgcugggacagacacagguguguuucuccucccagggaucagacacacauucggaucccucagggcacggaucaucuucacagccaugguggacaggugggcaccuucccucuucauucaaagaggggagaaagggaaaagauaauuaacagacauuucaagaacaucaccuuucauguauagccaucaaaggcuucaaaggccgucugaaaccaucugugacaccgacuuucauacacucaugugcaguaccuuugcagagacacaccgcugcccugugguggcggggagucacaaaacucagucuggcugugcuguguguugacaucacacuuucauccacagacaccuuuucaucgcagaacuuccaggggcaguccagucccgcgcagaguuucuggaauacauucaguauccuaacuccaaugauuuccucaaugucagucacggaagaguuaaucuugugcagaaguuguuuuguugagaucugagcacuaccugguuucucuacaaaaaguaagacguccagaugugggugagguucagaggacugcaaacuaacaaucuguaugucguuccuccucacacccaggauguuccguaaagcucgcuggaaguugcgccaguagucaccaacgaauucuuccggagugagguuggcaaagcggaucgcgauggugugguucaacaucuccugugugacuugucugauaugcacugugaugucggccaccgucgugaacuucccaucuguuacgcugacauugagaagguauugcccuaugucuagcuuuuugugugcuaucagcuugcccccugugcuggaaacagagaacagguuguccaucugagggucgagacuguagguuagaguaucauacacguccuggucuguggcauggaucuucccaaugacgccaccugaguauucuucuccagaagaggugaugaaaaucuccaggggcaaaaucgcaggcggauagaugcucuccucaauuacccuaaugucaauguaugucaaagaugacaacugaggcuuuccauuaucugccaccuacaagaaaagaaaaauaaaaucaccuuugucuauggcacuguuuauaacuucuucaauaaaaacauuuguauuacucaaguucccaaaaaauuacuaacugguagauacucauuucuccacacaagaaacguaucaaagaaaaggacaaauuucuuuauagcacuucacuaauucacacugaaacccagcucugucaaugacuaugacagaaucaacaaugagcuccuucaaacacagcgggauaaaaauggaagguauggcaaaaaacaaagacagcaauucuaugaaaguuuguuuuuguaugaaauguaagcuguucaaauagaagaggggaaccacgccaagcagcucuucucuaugaauccacaaccaaaccacaaagaaagccauucauaccuucaccugcaguaaguaaugaucuuucuccuuccucuugauggcagaugaugucaggaggacuccuugcggguuaacuucaaaagccuucucaucauuuccaguuacaauaguaaagaagaaggguggaccguuaugggaagaauccucaucuguuacuaccagcugcagcacgcugaagcccacuggcuuauuuuccugcacaagauuagaaacaaaauuaaacaaaaauccuggaacacagccaaaucuauaugggacagacacaugaguuuucuauaauauaaaauacauacaaaacaaagccuuucugcucuaucugaaaggaagagaagaaagguggagacgggagugugguggugaggaggagggaaaggagaagggguguagcgaaaagggaagaaaaaggaggaugaaggaaacaugguaagaaagggagugugaggaggaagagggaggaggggaagcagacacgaggaggagugggggacaggaggaagagcagagaggaggaggaguguaggagaagaagaggacuggaggagaaaaggaagagacgaggccaggcgcgguggcucacgccugucaucccagcacuuugggaggcugaggcgggcggaucaccugaggucaggaguucgagaccagccuggccaacguggugaaaccccgucucuacuaaaaauacaaaaauuagccgggcgugguggugggugccuguaaucucagcacuuggggcugaggcaggagaacuguuugaagccaggagguggagggugcagugagcugagaucgugccauugcacucuagccugggcaaugaguguaacuccaucucagaaaaaaaaaaaaaaaaaaagaggaagagaggaaggaagaggaggaguggggaggagaaagagaagagguugacaagaggaggaaaagugagaagggggaggaggagggguagugaggaggaggggugaugaggaggaguggcgacgagguggagggaggaggagaaagaguggagacagugaaauggggaggaaguggaguagggaggagguugggggaggagguggaguggggaagaggcagaguggggaggaggaagaggaggaguggagaagagguggagggaagaggaggaguggggaggggaguggggaggaggaagagaaggaggaggaauggagaagagguggagggaggggggaggaaugggagggaggaguggggaggagggaagaguggggaggaggaagagaaggaggaggaauggaauggagaagagguggagggaggaggaguagggaggaagaagaguggggugaagaaaguggaguagaagauggagcgagaaggaaggauugggggcuagaagaagagcaagagggaagaggaaggucaaggggggaggagagggcagaggaaaagcaccaguggcagcaggucugauuaagcaauaagcucuuaggaauccuagaacagugagaauaucucaaaaaucaaagcacggaaaggaaagagauaaaagcuuggcuuuaucuuuaaaaugcucaucuuuuaauacugauagcgacuucuugaauucuacguuucccauuuuucuagaaagaaaccuuuggauaagaaagaaaagcaacagaggccaauggaaaagcucauuucaaagaaccccaggaccaccuuggcacucgaagcccaccuggauaaugacacuguaguuuccccuggagaagacgggcgcguugucauugacaucggacacaucgauguucacggucgucguguugacucuggguggacugccauuaucagaagcuugaaccgugagcguguaaccugaaaucuuuucaggcaaaagacagaaugcacguucauuuucacaaggccgacagagcuccaaugaggaguguccuccugagaguccugacgggcaggucccagugagcuaccacuaucuguugcauccugccugugagcgaugcccuaaucuccuacaaacgagugcaugcaaguaauacacauuucccaacagcaagaauuaccaauaaugauuagauucucugaugccucuuaaauauguacuuguuuuguaaaagucuuuuaucuugcaguucuauuaacagaaacuaagacauaaaaguaauacaaaugauuaggacaagaaguuaacauaucucaaaugcuguugcuucgguaagaugggagcagccuuccuuagggccccaaguuugcucucaguggaaguagacagacaugagcugccucccgcaccuuagcgcugacucauuuccaaugccucaggacacuccagaucacccucccccucaauuucacacucggauuauacucagcugucuaaaucccucaggauuagcuugucaggaccucccacaaaagaaagaaagucaagugagauagcuucuuuuucagggcaguucccuauaaagcucugucuucuagaaugaguugugggagaagccagaaagcuggcuagaucccagaguauguucuacagaacguuaguccugcaagacgcuccaaugaaaaagaauucugcuggcgcauuagcuugggaaauaccacaggcuagcuccuuugguaucucacaauggacagaaguguauuaaaggaucuggguucuuuagucaaagauacuaaauuuauucugccccacagugggggcaauccuaagcaugcuucccaaauccuuagaaagucccuucucaacauucacacaucaaaggagaaauuaaagaauuuaaugagguaucucaucacuaucuccccccaaauuccuuuaaucuuagauacacccauuauucuucugaaauuucauucuuaaucaucaccaguguccuucucauucccaaaucgaaggcuucuuuugguucuccuucacaggccuaccucucugagguaguuccugcucagcuucccuuccuggacauaagucugcacagaugagugaauggauggaugaauggauggaugcauagauggguggauggguaacuggauagauagguggauggauaaaugggugaaugaauaacuguauagaugggugaaugaauggguaaguggauacaugggugggugggugggugagcaaauggguaaccacauagauggguagauggauaacuagauggacagguggguagguggauggauggauaacuggauagaugggugguggguggauggacacaugacuggauagauggaugggugggguggauggauggguaagugaauagauauguagaugggugagugaauagauaacuagauagauggguggguggacaggucgguggguggauggauggguaggugaauggguggguaggugaguggggagaugcauggguggauggauaacuggauggaugaauggauggaugacuggauaaauggguggauggauacuggauaaguggguggguggauguucagccuugcugccucuccuuauuuguucauauuuaucucaaucccucaugucacuucuaucaacaucuccaacggcaaguaccauaucuacacuuaggguuuuccagucucuaaaucugacuaaaaucuccaaauacuggcugaguaauucugccugaauaugcuauuucccuuuaaaaaccagcauauugaaaaccacauucauuagccucucccaucccuuacacguuuauaccucauaacuuuucuuuaaugguacuacccagucaaagcaagaccaaaaaaucaggcugccucugacaccaaugcuuucuacacggagccauaucuaagcuuuguggauucuaauuuuuccuuugcaaauaguuucuucauuugguauucauagacaccaaaauccacuggugcucaaguccuugauauaaaaugguguaguauuugcauauaaccuauacacauccucccaaacacuuuaagucaucucuagauuauaguaccuaauacaguaucaaugcaauguaaaugguuguuauacugcgggucgggguuguauuuuuuuuguuguuguauuguuauuuuuuauuguuuuucuuucuuuuucuggaggcagggucucacuauguugcccaggcuggucuucaacuccugggcucagugaauucucccaccuaugccucccauguagcugagacuaucggaggaggccaccacacccgacauuuuuucuuuucuaauacuuuucgauccauguugaguugacuucacgaaugcagaaucugcagauagaggggagcaacugaccuuccucagcucacaaaugcucauacccuagugccugaggcaucagguccaaaccucugguccugguuuucuauguggccaauaaccuguguguaaaauaccuuccuauuuuaucucacucugcuuucuucuuaugauuacuccaauacaacuggguaaaguccccuaaauauauuucuuggcuucuaucugcaugccuguguccaugcaauuccucgcuggaaauucccuucucucaaccucuaugauuuuccaaaccucugcuauuauuuaaaacccagcuucuagcuuuaggaagugucucagaacacuggaaccaacaguaauuccuuccugaaugcaaagcuuuauuauccaaacuuuauccuagcauggaacacauuucucacauugagaucuucauagugucauugcuuuucgaguguuuacauguugccgucaguucuugaggcggucaguccugcucacaccacgcccagcagacaagagcacaaggcauuucuaguuauugauguggugauuuguaaacaacguaaaucaaccuuuuucacuuaccguuucucggucgagaaguuuggucacuuugacuucuccccugacggggucaauugugaacgagcuuccuugguugccaucuauaauugaguaguggauguggcuguuggaagguccaucggcaucaucggccauaaccuagaacacaccacacuccuguuuaggagacagcuaagaagaggccuaaaccuauuacacaaaauuugugauauuaauagcuuagcuguuucuuuuuguuguuguuuuuuuuuugagauggagccuugcucugucacucaggcuggagugcaguggcacaaucucggcucacugcaagcuccgccuccuggguucacaccauucaccugucucagccucccgaguagcugggacuacaggcgcccgccaccacgccuggcuaauuuuuuuuuguauuuuuaguagagacaggguuagcuuagcuguuuuaacacaauuauucauaacaaagucagcaaucaguuggccuaacaaaagacacuuucaaaucuccaaaauauuuacaaaggccgcuacaaaaacuagauugauuuuacuaaaaacuuuugcaaagauccagaagauacacaguuuucacuguaauggggaaaaaauacacaccgugaugacagacugcucaagaacggcaucuucacugaugacugucguguaggugucuuggcugaacacagggguauuaucguugauaucuguuacauuaacguucacaguggcaacgucgcucagugaaggcgugccuccaucaguggccucuacuguuagguaauacucaugagagcucucauaauccagauucucaaugauaaauacggccccugaauagaaaucaaaauuacuuccagcauucugcaaugccaccacauuuucccacuaugacugaaauagaugaaugcuuuugaguacauuuaguuuucacuucaaaaguuuacuuaccauuuacguauguuuccuauuuucuuaauucaacaauuaaaaacuaugaaucugcccaucccuggaucuuuauuucucuuaauuuucaugauauucuucaugauauuuaaauugcuuuuccagucaacaccaccuacaucccugcuuauuauaaacaugaugauuguaucaucccuuccauaccauagcucacucgacuucacucuaauuuaaucaacaaaauaaaaacguaaaaauucuauugugucuuucgguuucauuuuuugucucaucuuuuuaaaauauuuuccuucucauauuuuuaaaauggagauuuauauccuuuuaacuucuagauaacccuuuauuuacauccucucauuuuuaaaaaucccuuuuuaaacaauuccuuuuaacaucuuucacaucauucuaguccuaaagagcccuaaaaauaauuuuauuauaaauauaaauuauauaaauauaaauuuauauaaauuauauaaauauaaauuauauaauuuauauaauuuauauaaauauaaauuauauaauuuauauaaauauaaauuauauaauuuauauaaauauaaauuuauauaauuuauauaaauauaaauuuauauaauuuauauaaauauaaauuugaauggagcaacuuucuacacuguuuuaagacuuaggacuauuuuaggccacagguuagcaagaugaugaagcauucacgcagcaggagucagcaguuccuaugccuuuugagcuuguuggcggucuuucccuaacugugauucaaaguacuccaacuguuauagacaacuagcaugauaacgaagucaacuuaauauauuaucagaagcccacuacagaaacuaaaauaaaaaagacuggaauuacuauuucacuugggaaguuaccauccaugagucugauuacauaaggaccucuacuauccccuauucuuaucuuuacuaacuugcuauaccuuacaucucaacuaaacuaauagaacaugcugcuuugauuuucuauuuuaaguuaauuugcuuguauuuuauaaugaacaugcccaaaauguauuaaguagaacuauaaucugaagccuuccaaacaacauucaaucccacuguaaauaacuaaaagaaaacuugauuugccuuuuuuagaacaucuacugacaacacagggucacuuaauacaaggcaacgugguuaagcaaaucuaguuuucuugguggaaugaaggguuuccucucagauacaugguagguuaccuguuuuagaaucuaugcugaauuucccauguucauuuccacuuauuauugaguaggugauuucugcauuugcuucaauaucccgacuugcugcauacacuugaagaacuucaguuccaacaagaauguccucagacacgguggcaccauauucacgguacucaaacacagggggguugucauuuaugucaagaacugauacaaucacagugccaguggcagucagccuccuuggcaagccuugauccacagcuuucaaagagaggguguauacugccuggaguucucuguccaaagguuuuucuaacugaauaauuccagauaauucguuaauggagaacugcccaucagcagagucaaucagugaguauaaaaucuuccgauuuaauccuaugaagacauaaaaacaugucaaaagauuuuaaauaaaaaaguuuaacacuuuuuuuuuuuuuugagauggagucucccucugucgcccaggcuggagugcaguggcgugaucuuggcucacugcaaccucugucccccagguucaagcaauucuccugccucagccucccgaguggcugggguuacagacacacuguaauuuuuguauuuuuauuagagacgggguuucuccauguuggccaggcuggucuugaacuccugaccucgugauccacccgccucggccucccaaagugccaggaucccaggcgugagccaccgcacccggccaacgcuuuuuuuuuuuuuuuuaaaaaccaaacaaaauuuuuuuagaaggguaaacgcuaauauacauuauucgcaaauuuguaugacuaugaccuuuaaaagguaaacaacuuacucuguuaaaacaaauguaaauauaauuucaugggaaucuggcuucuuagacuauuucguauaggagccaauaauacaguaccuaacaaaccuuuacaaaucacaucuguuuaucauugagcuuuggugacaaagaucugaaaagcaacacuuuugcuauucuucugaaacuucucagaaucacagcaugaguaucccuaaacugaaaaucugaaauuugaaaugcuccaaaaucuauuaacuuuaugagugcagaaccgaugcuuuaaaaaaaaaugcucauuggagcauuucggauuucagauuuuuggaguugggauacucaacugauaaguacauaaugcaaauauuccaaaaucugaaaaauauccaaaaauccaaaaauacuucuaguuccaacuauaauaaauaaggaauacucaaccugugguaugacugaagaaguuauucucugcuaucaaaugcuacaaauauacauucuauaguccaauuuucucuaaaaaaauuuugaaagguuuguaaaccuaucauaaagcauuugcuuccauuauguugcaaugaggcuaaaagcucucucuguccucaaugguuuauugacaaaauaacacaucacugauuaauucaaugggaugugaagaucaguuaauauucaguaaccagaauuuuagagaccucacagcaguagguucacugggcacaacuuuggaacuuuaaauauucauuaaaaauuaauuaauuauucuaaagauuuccuuccacaaggaagggcuauggaacaugcaugagguggagugaguggcacaggcugaaucugggguguguuuugaaacagaggcuccuaggaucucagugagcagcgucaggcaagagcauucccgggagauaccugcgucggcaucuguggccugcacucuugucagcagcguucccggcucuguguuuucaaacacggugauggcauaaggaucggcagagaauucgggggcguuaucguucacaucuucuagcgugagcacaauacuggcuuggcagaaucuuccuccuccaucuguggcccugacgagaagaugauaaacagcuugcuccucacgaucaagggggguugacguuuucaguucaccuacaaacaaaaacaaauggacucacuuguaauuuaagacgugacuugcaguuguacaucuuauuuccuccccuuuugucuuucaauuacuuagucugaguauucacagccuuccucuugagaccaguauuaucaaugacagauucaacagcugcaagaggcagugagcuccaggucuccaacccugccaggggcuagcucuuuaaguccugcaggucugaggccagggccucucaccuuguguauaagauugcacaggugaaacagcuaccaaauuuaccaaaauuuaaaaaauguuuaaauugacucaaaaauuagauucacauguucacaauuaguucuuuaggaagaaaauaaaaaggcuuaacaggaaacuuaguugaucccaauuuuaccaaaauacaaaaggaaaacaacucuauuuuaaaauaaauaaaaucccauaaaucauuuuguuuaugaaaauucuaaauuaugcuaaguuauaaauuuauggucaccaauucaagaaaauaugcuauuuaaauaaaauggauaaaaagcagaaagcuugaguuauauuuuaauuucugaggguuguuuuuuuuaaacaagugguauaaacgccuucuaaauuuuaaauccuuuuuucaauuaggugauauucuugcuguuuuuuaaaaaaucucaccuugaauuuuacgcacuaaauugcugguaagauuucuaagagaugucaacuucggagcaucagaauacauuugaaaagggcaaaauguaauuucaaauuuugugugugaucuaaaaucacccacauauaugauacuguuggaauauacaauuuauuuugucccaaacuccaucauuaccugugucuggauuuaguuugaauuuuucugcaccugaacccaauaacguguaaguaauuucagcguuagagcggaugucugcgucuguagcagagaucugcaugaucaauuuuccaggaaggacgucuucaggaauagugucugaauauaaagucugcaaagaguuuaaacaaaaacguuacauaaaagcauuaacaggcagcacaaacaucaagggaauaauggaaaagaaaucauucaucuuugaccacagaaaacaugggaaaugacuaaagauaaaaucccaagagcuuugaaaacgauuuuucucauaaaacauaaaacacaugugaaacaaggaggagccguggagcagccaccagcuccacaucccugaaagagccuggccugacauuuaaccuacaaaaugcuauuauauguuauuaagcugauuucauauucaaauccuuaugagaaaacguaaguacuaaucaaaaauguaaguagugcuccguauuuaccuaaaaacugcagagaauaaauaucugucguaucauaucugcucauuuccaaauacaggaauuuauuuuuugcaaauguuccuaacauaaauaacugcaguugagagagaagcaaguuucauguuaugggagaaaacgaagauucucgaaggccacagaagggacucugaugaaggcugaggcccuucuacugcccugcgugauccuggugcccucucuccucacaucugcccucaugcucaaacacggugaacacuuguuuccaguuccaauuauuuagaaauccaugccauaaauuaaaaccuaagacaaaaagauuaagauucuguugauuuucuuaaucugaacucaacuaccagugaaguacucacggaaaaguacuccaugaaaaaggacucaggaaaaaggguauuucauaauaggaugaauuuaaaggaucuagugucccagucuuauuccugaagaugauagaguauuguacugaaauaauaucaaagggcuaaaaaacaaccaaagacaguugcuguaagagagagagaaugucgcaccccuucugaaaauauaaaguacaaauaagaacuggaauuaacuccucaucccucagaaguuccccuuccccucaugacugaauauaaggguucuuccaucuuaagucuuucccugagaacagcccuaucacuuuccacagccacaagcaucucagacucacagaaccugugguggguuccaacuccuccauccucuucacaaucacauuccucucuacccagccuucuccuggcccagcacauuccuccucccugucacucucagccuucuucccugggcaggucuauuucuucaucacuucacucucugaucugccaucaggcauccauccacguccugcuaccaagaccgccaccuacacagcaucacgggacccaaauggucuguuucgcaucccaaacaucccagcuccacucgccacccugccuccccaaaguccucuucuccccaacccagguuggcacugcacugguguccuccucuuccuuccagcucagcucccuucucccuuuggaaauagcucucucuucuuuuucccuuuuguuaguauccucucaaaugaagucaauuuucagcuauccagagacaacgccaaguuuccacaccuuucccuaauacccauccaacaucucgccaucucucaaugucuaaaaaacauggucaacuguaugucucauuacuuuagcaaacuggaauuggaacucaacacggaacuccucuaaaaccagcccccggcucagacuccucuuugccacggccuuggucgcucccccuacucauguagaaagucgggcucgauggcaugcuggcuggcugucacaccagauggucuuccucggugguggcuuugguccuuucacuccuuccccaccucugccuuuccagggcccccuugcauccacuccucccugucuaaauaaugggcacgaugcuuccaaacuaagcuuaagaacucgucucaugucaucucuaccuuaccgauauaaaaggcuccaaagucccuauuuucucuaggaucgaguucaaaucccuuggaacgaccgccacugcccacuguaauccaguucacccuuuuccaagacucucagugcagacuccccacuucuggcaaacucaguggcuacucccacaaucccuccucacacuccauggccccuccccacccacuccugacgacccacuuacugccccccgaagcugagccagcccuuucucugggcagcccuucucacccucuggccccagggaccaccccugcucgagccacaugcccucaucuaaccuuggagggagcagcccuuccuacgucuacuuuuaguucccacugaauggugagccgcgcagaugcaggaagcacgcuguccaccucugagcuucuccagcgugcagaagagcagaugcccccaaaacagugucucacggcacgucggcacuuuguuucccgucagauccuucccccaaaacagcuguauccccauauuaagagaauccccucaugaaaagguuacagagcauuuucaguguuggaugcaacuggaguccuguccguaauuuaguuuucuagaaugaggcuuuugauuuauugagcauucccgcaaauaguucugaagcuuuuccaagucuuaccccauuuaacaccucugcuuaaucaguaagugaucauaaaacacaugugaauuacaccacagcgccaaaugauggucccauugaaagaauuaagaaauugaaauucauaacacacaaauguaagggaagagcugcuuaccuuuucacaaacuggacuguugucauuugcauccagaacuuucacuucaacuaucgcuuuugaugagaaggugccaucaguugccgugauaguaagaagguaauugucccuuuuuucccugucuagagguuucuucacauauaccuuccauucauucuguauaguuucaacggcaaacuguccuaaaggauccccuccuauuaaaucaauggaggaagauaauaaucaaauuuguugaaaggauaaaaauaaguaacagaaaaaauaaacuguacaaaagauguauaauguuauaguuuaaaagaauugaguauuaaaagaauuaauuuggcauauauuagccuuccaauuuacaaaaacaagggcagcauuaaaaugcauaaacauagcauuaagacuacuaaucauuuagccugcauuaaaacuauagauguuuuuaauuauauuuauuauacacuaaguauaagguucaaaagaaugagucacaaaaaucaaaaacagucuaaugaaacaacugguagcuuugcucagguaacaagcuugaaaugaggcucaacagauguuauuucuacguauuauuuuagauauuuuuaacuaaaaucaucccuuaaauccccaauuuccauacaauacagaucuuauacuuuaugcuucuaaaaaucauuuuaaauuaauuaaaccguuugguaugaauuuuuuuuaccuguuaugaaauauguaacuugucuguugaucucuucagaaucagcauccgugguacuuaagauggcaaucaccccaccuugggggucauccucacucacagucccuuuauagaucucggccgugaaucgugguggacuaucguugacaucggugacgguaacauccacaauggcuguggaggauagcuggaucuuuucaccaugaucugaugcaaccacuuuaaucugguaauugucucucuuuucauggucaaguuccuuuaaaguuguaauccagccuguuuccauguuaauggcaaaggauucaaugacuuccacacuuugugacugauccaggcuauacauaacuuggccguugguuccugagucagcaucagaugcccugaucugaauuacucuacuucccccuggcagguuuucaacaaugaaugccucauauggacuagauucaaagaccgggcuguugucauuugcaucuuucacuuggauacuaacaucuacagaagccaccaucucauggucaucuugagugcaccuggccaguauggaaaacugauaccacuuaguugucucaugaucaagacucuucuccaacuucagucucccgcucugucugucaaucacaaaggacucaucccuauugcuuucuggaguauucccuuugaccaggcuguaaagaacagucccacuauguucugcucggaugagaucuaucucuguuccaauaggcacguccucugacacuguaaagguauagaaagguucugaaaauuuuggaagcugcauuuccgguggaaggauuuuaacauagacaagaacaacagauucuuuugauggagacccauuauccacagcucuaacaaagaaagugaagaauucauuuuccaagccaaugaggcucuccuuuguagugauuacgccggacaguuuguuaauuuccaaauucucuuuuacacuuucagagucugcuucaauggcauaggugaugucggcauuggagcccucaucggcaucacuugcaagaacuuuaacgacugaagucccuuuagcagcacuggacccgauauucacuucguauuugguugcucgaaauuguggugcauugucauugucaucuguaaggaugacauucacggugcagaaagcaacuuuuccuccagcauccuuagccauuaaacggacugagaucacuuucuccgccgggguuucucgaucaaguuuuuccaaaguaaauaucuguccucucucauuuauguaaaaucugucuuuggcaaagucauuuacaauaugguaaguaacgugaccauaaauaccagaauccccauccguaguuuucaccuccaucaccaggguauguaggggagcguuuucagcuaguuccacuucauauucguucugaaggaaagcaggacugugcaaauugccuccaauuacaguuacaugaaccuggguggaacuucuaaaaacuccaucagacacugacagguuaagacuguaaaauggcuucagggcgugccggugcagguuugagagggugauaaucccuguugcacugucaaugacaaaauguuuaugaucauugccagacagaauggaauacugcaacuugucuaugucugaacugucugcaucauaggcuuuuacacaggucacgaaaugcccaugaggggcgugcucgcuaauucuggcuucauaaaucuguuguucaaagagugguggauuaucauugaggucgguaacguccaccgugacaaucacaucacugcucagcgugggcauaccaccaucaacugcccucacaaaaaucgugugcugccgggacugcucguaauccaggguucugaguagugagaugaggccagugcugcugucuacaugaaaaugaucaugacucuugcugugauucccaaacaucugguaugagauuccucuauuugguucugaaucagaaucgguggcucuaacuugaacaacagacguuccaauuacagaugccucagacagggucaccgcauaagacugcugagcaaacacaggaggguuaucauugaugucgucuacuaugauguccacaaauacuucagcaugagcgcccgucaaggagucaguugcgcguaugcucagcuuauaugccgggugggccucaaaguccagaggagcuaugacauugauaacuccaguauugaaguuaauagugaacuggcugaaagggucuccgucugugaugcuguagaacacuuucaggccuuccgggcuguuagccugcacguggaccacagggcugugcaccuggaugcucucugcaaucucugcacuguagaaagguuuuucaaacacaggcauggcuuuauucaugacagugaucggaacgauaacuuccgcugaaaaggccggguucccuccaucuuuugcaaccacuguaacaagauauucuuuauuuaaggugucaagcucaaauugcuuuuucagugaaauuucacccaaggguccaauuugaaaguguucaugauguuccuugagguaguaaugcacuuccccguuucugccacugucucugucuacagcagugacauagcgaaugacauggcccaccucaguguccacuuuaacaacggcguaguagggaagguugacaaacaccggcgcauuaucauuuuggucuucuacaaugaccuucacgacaacgugggccacugcagaaggcuuauguuccucugucacuucuacaaccacaucaaacgccuccugcugcucacgaucgaagggcgugccagugguugacagaacuccugaagugcggcuuauuuuaaaucugcgaucuggguugaggaugugauaaaacaaaggcucauugauuggauucccaauagcaguaaugacagcuaauguuucggccucgguggaauucucuuucacuaccgcagaguagacauccuggguaaacuuuaggugacuuucuuugcuuucuuucacauuaauuuugacagagguaaggccggcaaaucugccaucggaagcucuaacgguuagcucguagcggcuucuuaacugaguuguguuuuggacagugagagcaccagucuuguaguccauagaaaacuucuccccgauguugccuucggugauggaguaaaucaacugugagaaugcacuugaaucagcaucuguagcauuuacugugaugacuuuuacuccuuuguauguugguaacaaaagagaugcuucauauaauggcuuggcaaacacaggggggcagucauuaaugucaauuacauguacuguuacauucgcugcauacucagcaaauaaacgugggguucccaugucaugcacuuggacgguaaagugaaaaauacuuguuucuucauaguccagacuuaguacuguaugaauagcaccagugcuagaaucaauagcaaaauauguguguacagaugguucaacaaugugauauacaagcaaagcauuugagucuuuaucagcaucagcugcucgaaucaccagugggacauuccugucuguuaggaccacgcuguuaauugaggcugauucacuaaugaguccuguauauucugccugcauaaaaacuggcgcguugucauucucauccugcaagugaacuagaaccguuguauuaguggacaaaccagccauguuaguuccuuguauuaucaauguguaaaugggcaaaguuucaaaguccagggcuuucugagugaugauaguuccagaauguggauuaauaucaaaagcaucaccuguauuuccaucuuuuauuucauacaccacugaugauugacuaugggcuguaaccaucccaacgaaacucccaaugcugacaguuucacuaaguucaacagaauauucuuuugauguaaacuucggagaggcguugucagcaauugugacaaagauacgcacagaaguuauuucacucauugguggacugcccuuaucuguagcuuuuaccauuaaaucauacuccgcuugguuacuucgaucuaauucuuuggcaguuuuaauagagcccaagacaggaucaaucauaaaagaauuuccaauauuuccuggaaggagaggaaaaaauacauguuacagaaaaacacaaggggcaguaguaguaguaguuagagaaacagaaacaaaguauccuuaaaaauuauauucugaaauuaagcagaaacucaggggaugucaauauuugaauggaaccuucaacuuguuuuauuuuuauccaccuaaaaccagguauacuuuacagaauuuuguccauaaaugaugaaaaacaaaaaacagaagaaacagcacucugcucuuagcgaagccaaaacucccucucucggcugcacugggaaugugugguggaaagacaaggcuauccuuccacaaagcaguugagugagucacuuuccaggagucccucaaaacacuucuggaccacauuuguauuuucaacgguuaugacuuacaaauucuuaagauauguauucauuacgaaagauuucgauucaguaagaaauugacaucaagcuucaagagacaauuguccauggauaaauguguguaacccaccccacuuuacagguuuugaagauugcaacaacauucccuucuuaucuuuuucaggucaacuuauccucuaggucagugguuuuccccugggggcaauucugcucccuaggagacaucugguaaugccugcagacauuuuugguugucacuacuugucggaagagggugcuccuggcgucucguggguggagaccagggguguugcuaagcauccuacaacgcacaggacagcccuacacaaccaaaaauaucugguuccaaaugucagcagugcugaagcugagaggcugcucaaagauagaguguuuuaccuccuuuucuuuggaccuuuucaggcuauacuguauguaucuuuagcugcaaccacaacuccagaauauuguauaauuuuguaucaucgacugaaucuucaaagaaacaagcaguucucuacagcccuuuuggauaaaucaggguggcguugcagguucucagguuuaauccauccacgagcccauccuuuuucuguuucaugaacaagcacccagaauucaccaucccugucauagcacagaauuuauuuuccccaaaugaacuauuauacuuacccaaaacaaagcucacuugccacuuaacugcuuucucagauucuugcucuagguuugccacgaguguggcauuucacagaccagaacugcucagugugagcugcacaccagggauucaccaagcacuuuguucuccacaucauuaacaggaaacacuuccucuacagucuucacuuccuuccuuucauacauuuuccaaaaauccacggccauuuuuuagagaccagauccagccugcuuuucauuaagucuuacuggcucugcauccgagccccaaggcagugccucagucugcaacaggguggaggcccaggguuucucuaggcccugacgcucugagcugaacccuggccgagaacuggguccugcugccucugccaggcuuuugagacacuaauuuccggccugucuguacuuaugagucagugaucccagguccuuccugauugcauuuuuggccgucgucagaacgccaagauccuuuucucaucccaccuguacaucacccucacugucuaaaauugugacugacugccuggccugacacaggagacuggggcagccauggugacucucuucaucccugccccucagacuucccuaugucuguacucaccagcugaccuaccauauuuuauauucauucuucuauauccacuucucucuuauuguacaggauaaucuuaucuugccgaugaagcuucaaauaugcaaggccucauguggaggaacgaagagacuaucugcuguggaggaggcuggugcugcuagaacacacugcuuucugcaaaacuugcucccugcccuccagccaagugggcauucucuuuguccucaaucaggagagcacacucaucucagagccccagugucugaugcauccucuccuggaagagucuccucccgcuauucuuacuguuucugucucaucgcccuguguuuucuuuacagcauggauuacaaccuugcucuuuaucggccaugcaagauucagaaacauccucuauuaucuggggcaucaugacucuggugaacacagcuuggagcaugucacugauaacaagguuaaacaggaacccagcucgugaugggauacaugaaucccacauccauauagauuaaggcagaaaucaucagauuugcaggugggaaagcagcaucguguuuaugugaagaaacaaugagggcugcugagugguagaaagugccccugccuggccuaacaacagguucauucacagacacugagaugcacuggugcuguugaacgacuuccuaagguggcagaaaaggucuguacgaggcugggggcuuauucacugacuuuagcuacaauaugagugauuuuuaaacaacuuuaaauuguucccuguaugggaacagggcaauuaucuagacaaacaggcuaauuuuuacucuuaagcuauuaaguauauuacacagaacugugaaggggagucuguuucuuccccuguagacacacacuggauguucagcuggggccccacugacuggcagaguggcacccuccguugacucucaaggcaauuacuuaaguuuggggaggaaaaccaauucuaaucaauaaguauauuuauuuauggaguaucuucuauuuccagguauuaaaaugguuuagaaguagugcucuaauaaucuacuuuuuuaaaaagauguaagaagaaaacacacagaccagaguauggcacugacaugucuccagcauauaacucaaugguuacugaaaauaucucuuaauuaacuccuuuuucccugaauacuccuaaucagaccaaaccuuuuacucaauuaauugcugcuaauuaaacaugcaguguuacguacugaauuuguaacuagucuuuuugaacuuuaaauguaaucugacacaaauuagaagcagauaauuaugaauaaacuuaaaugaaaggcauuuguaugaacauuuuauaguucguacuauuccaacagauguccaccuccaucuccaacacaugcacacaccccuuccacaaaauucuacugcauuuuaaugguaguggucuccuacaaaguaacugcugagcauaauuuuuauauuaccaaaacuauaaaaauagcaucuuaaaaguccuaauucuaugccagaauaggccauugguauuaucuauucauggaggagggaguuccauucucugaauaccagauuccuaauccugucagucauuagaagcauucaaagaaugcacaugcuucuacucagacaccaacaaucauauuuuaaccacccaguuguugacaauuaugugaaagcuaaggggaaguuuaacauuuucuccuacauaaacccagucaguuugucuaugacagaauuacuuuauugaaguacgcaggcaugcacaaauggaaugcacuguuuuucuaacugcaaauuucucaaccaguggaaaaaaacuucaucuuuacucaaggcacuaacuacacuacauuuuaacacugcaaucacaggcaguguaugagaucuuauuugugacuaaugaacucgauuugguuguuuuaagggaaacaaaugaaauuucaaauauguuaaauaaacauaguuuaaccaccuagaacacaucaguaaguuuuuuaaaauuacucuccauuuccucaaauuuuuauuacaugaucuauaauuaaucuauaccuguaccaauucuaaugccuaggagagacaauuucuaaauauguagagcuacagacuuaaaaaagaaaacaaguuaaauggaauauuuuaauucucuaaacucauuaugaagaagacugaaagggacuauauuccuuguacuaacaauggcacugaagaaaacagaaaacuguaaacugucuucccaacauuucaucacuuucagaggaucuggcaugagcaggaacauccuaaagcaacgugacuucugauuguacagacuguaugcucuaaagcagagcccuguuucuaucgggguggaacuuuuacaagacacgcauuguggacccaauggcaacgccuacguaccaugcccaggaggaacacucccaacauggcaccuggcacauaaagugagcuucaccagcccacagaaugaaugaaugaaugagggaccaacauggcaccuggcacauaaagugagcuucaucagccuacagaaugaaugaaugaaugaaugagggaccaacauggcaccuggcacauaaagcgagcuucaucagccuacagaaugaaugaaugaaugaaugagggaccaacauggcaccuggcacauaaagcgagcuucaucagccuacagaaugaaugaaugaaugaaugagggaccaacauggcaccucgcacauaaacugagcuucaucagccuacagaaugaaugaaugaaugaaugagggaccaacauggcaccuggcacauaaagugagcuucaucagccuacagaaugaaugaaugaaugaaugagggaccaacauggcaccuggcacauaaagugagcuucaucagccuacagaaugaaugaaugaaugaaugagggaccaacauggcaccuggcacauaaagcgagcuucaucagccuacagaaugaaugaaugaaugaaugagggaccaacauggcaccucgcacauaaacugagcuucaucagccuacagaaugaaugaaugaaugaaugagggaccaacauggcaccuggcacauaaagugagcuucaccagcccacagaaugaaugcaugaaugaaugaaugagggaccaacauggcaccuggcacauaaagugagcuucaccagcccacagaaugaaugaaugaaugaaugagggaccaacauggcaccucgcacauaaagugagcuucaucagcccacagaaugaaugaaugaaugaaugagggaccaacauggcaccugacacauaaagugagcuucaccagcccacagaaugaaugaaugaaugaaugaaugagggaccaacauggcaccuggcacauaaagugagcuucaccagcccacagaaugaaugaaugaaugaaugaaugagggaccaacauggcaccuggcacauaaagugagcuucaccagcccacagaaugaaugaaugaaugaaugaaugagggaccaacauggcaccuggcacauaaagcgagcuucaucagcccacagaaugaaugaaugaaugaaugaaugagggaccaacauggcaccugacacauaaagugagcuucaccagcccacagaaugaaugaaugaaugaaugaaugaaugagggaccaacauggcaccuggcacauaaagugagcuucaccagcccacagaaugaaugaaugaaugaaugaaugagggaccaacauggcaccuggcacauaaagugagcuucaccagcccacagaaugaaugaaugaaugaaugaaugagggaccaacauggcaccuggcacauaaagcgagcuucaucagccgacagaaugaaugaaugagugaccaacauggcaccugacacauaaaacgagcuucaucagcccacagaaugaaugaaugaaugagggaauggcaguggaaaacagaccaaaaacauccugcuaugccaggacugcuuccugguggucccccuuguuaucccgacucuggaucucuuggccucugggucccggaaccguccaggaccgcagcuccagcuguuuuuuuugcugcccuugcugccucaagccccaccccagcaggccccagcucuggggucuaguccucaacccaauuccaugagggaaauccaccuguuaaaggcgaguggcaaaaauccagguaaauguggaaggggugggaggggcacgacaccucuuucugagguuucagccaauuacaaugagaugagucaacacuguuauggagcuuccugcucugcucaagagaaaauacucucugacaaaaaagugaaacguuaaauuacuaggcaagcagcuuccuaaguguguuuaauuuaaccaauguuacagaagaaacugugguuaaaauaauuucagaaauacugaauuggucaaauaaaguuuccucuacuacguggcuucucagagccuugaacugggcuaauauugugaaucccccagaacuucccccaaacucucugaugggcuaaaaguuaaaaaaaaaaaaauuccuuucuccuaacauguaaaauuguaucuagagaucaauuuaagccauuuuugcagauacauagaaaugcuucaauacccagaacugauuuuggaaaaguagaaacagacuuuuaacaacugcaaauuuaaaaugccacugaaggcuccaaaaguaccugacucgaucgaguacagcacuucagcauuuuucccuuuguccuuguccagagccgucaccugcaacacaacugagccaacggcugccgauucauaaacccgcccuuuguaggaggaagcggugaaccacggggcguggucauucgugucgcugacauugaccacaauccuugcaaaguugcguuuuacaggcacaucuugaucucguaccuaaaaagaauugacacauuaucaaucccauuggugcuuuccuuauaacuaauuaaaaaucacgcucgaacacacaaaggccucaggaccaaauggugggaggagagcggguagagcgccuaccaugaccgugagggugugcuggugaacagcuucaugauccaguuucucagaaguauagagagagccgguugcaggaucaagacgaaauuucuugagacucaguggaucucuacugcucugcagaguguagauuaguuuguuuuucucauccugauccacagcacugauuugcaaaauuucuguuucuggcgcuguaucuucaggaauaacaacuucauacuuugauguagaaaacugaggacgauggucauuugugucuauuacuuugaugaauaccuguaauggaugacaaaaugacucauacaauauuuccaauuaugaauguuuuaauacuuaaagaaccaugaacgaaagucauguauauugaaacgauacuguggcaaaauaaaauacgagaaaggcaacaaaaaccuagaaucauacauuucuuaaaacauuucucauugguauauuacuuaucuaaauaugaguaagauaaugaugaccuuucugcauucuuauaacuaacucugggacaaaauauguauugauuuucacacuugccacgucuuuacgugggcuuaacuucucuuacgccuccacagagaagguaucuguaggucacucauguacggauaacaauuuaccaggauuuauagaagacuaauuucuuaaaucagauuuguaucugcaacuaccaacccacugagguaagacagaugauuacacuauccaaauuucucauucucaucuuugacaucccaagccccugaucauagguuuuuuuaauacguaaaaagaaaaaauaagaaauguguuuagaaaucacuguauuucugugaucauaaaccuacaucuauguaguaaauauguuuacucccuaaaaccaauuuagucaauagauugaaaaaauaaacucucuuaacuaugucuacauaaaguaaaaaccuuuagaggaaaaaagcaaauguuaagaaacuugguacuaagcuaaauuagaaacaaacaaaacuuugacaguaagaggauuaauuuccauaaugaaaagacguauggauuuggcacagcggaaaucacugccaauuauaaaacaugcuuuagaguuuaagaagaagaaaacugcgcuucgugggggcauauggaacaaagggaucugcugguccaagcagcacagggggccagggucccaggcagagcggucaaccacauggugcaggccaugaacagaggccuuccuuccaugagggcuacaucaguguucucacagaagaccaaaauaucaaggauguuuuaguuaaauaaaacguaacauuacauuuuguaugaauuccagaugcauccaccaaaccacggaaagguugcaugugaaagcuauguaaaccuuuaaaacuacagaugccucacuuuuacaggucaaugaugauccagaagggauggcuauaaaggcaauuaccauagauuagauuacauauucauuuccacuauaaauuuaaaaauuacuuuucccauguaguggguacugagcagagaaguuuaauccugcuccaagcucaagcauuauuaaguagaaagaacuggaagucaaagcaauucaauugaaacacacggauugugcguuuccaugcccaaugcuugccugggugugaaaucagcaugcaauggucucugcccucauagagccaccaggcuuaccaggcaauguucugcacaugcacagccuaaccaugucucauauauuaucauguaaaguuuuuaagaguccagagacuggcugagauauucagaaagcucuuaaggagauaaugcuuucuuggguacauuuuugguuggcaggugaguaaguaugaggaagggcugcgucaacgacaugaaggcaagcagugggacggaacauccugccuuucagaggcuggagaggacuuggaacucaggggugauacaguaaaggagcaagaagaaggcagagucaaauacgcagagccucgacuccagaacugaugugggaggacuacacagcuccuuuuggucagaagaaacucgcuuccaacaugaguggcagggaugaagaauggcgacuggaaggugaauugaguguuggugggacaagagcccaaaccagugcugaugugcaacaagacuauggcuuucugcgugcuuacugggugacaggcucucagaacgugaagaacaagcacccugcgggucaccucaucaaccuuccuaagaccuccaaaaggacgauuaucaccacccccacuuuguagaugagaacauggacacacagagaguuacagcuauuugcccauggaaaggaguacaagagguggagccgggauucaaaccaagugaucugcuccagaggccacgaugcugaugcucgagagaaaguuaaagaagauaugaaagcaaaguuguuugaaugaaagaaaaaaaagguaacuggauuugguaaguuaccuggagauacaagauaaagccaagugacuggaaucaauggcggucagcauccuaagccacacacgcaggacaggaaagccagagaagagcuguuuccgcagggcacuggcaguucucccacuguccugccgccuaccucugcuggaggcugcccgcuugacucaccaacggcucaccuaaaccuucucaaaucggcaucugcugccccugaccuggauacacaauggcugcucuguugacuucugaguguuacuuccaagccccaauccauccccgagguauccuagugucucaccucccagcugaccccucugcucuucaauccauccccgcaguauccuagugucucaucucccagcugaucccucugcucuucaauccauccccgcgguauccuagugucucacugcccagcugacuccucugcucuucaauccauccccgcgguauccuagugucucacugcccagcugacugcucugcucuucaauccauccccgcgguauccuagugucucaccguccaggugacuccucugcucuucaauccauccccaugguaucguagugucucgccucccagcugauuccugugcucuucaaucaauccccgcgguaugcuagugucucacugcccagcugaucccucugcucuucaauccaucccugcaguacccuagugucucaccucccagcugacuccugugcucuucaacccauuccugcgguauccuagucucucgccgcccagcugacuccucugcucuucaauccauccccgcgguauccuagugucucacugcccaggugacuccucugcuuuucaauccauccccacaguauccuagugucucgccgcccagcugaucccucugcuuuucaauccauccccgcuguauccuggugccucucacuguccagcugauuccugugcucuucuccagguggcagcugcugcaccccccucccgcccccacccaaauucauauuuccagguucucagcuaaagaggaaaaauaaucuaaacacaaaucauucccuuugucccacaccuuaacaggucaaccugggcuacuguucucuuauaguccgacugccuuucucugccagcgauuaggauagcaucuacagccuaugacaauggcccaaaaauaaguuacagaaguauaaaggaagcaaugaaauuuaagauauuuuguguuuccaagaaagaaaacuagaauacacuuccuggguuuuauagggauuuuaguuggugcacgugauauuucaugcuaaacuuuuaacugcacuaauuaaaaauauaauuauugggaaagaggugcacuguuaauuauucauagacguagggucuuuaguaaugagaaugcuuggcaaagagggacagcuccacuguuuaugaagcuccuuuuguuagauuucuggguagucgauucugugaauuggucuacaguuauaccccuuaaauccuucucucagaauuauccuauuagauuuauuacaauuuaugauguuuuuauucucauuuuugugcucuaaaauuuuacaagggcuuauguuuaaagagagaaaaucaauagauuuugcuugucucuagaaugagaacagcuaccaacuaaauugaaauuuugacaccauacuagaacuuuuacaagacaaucucaaaaugaccccaaaagcauauaacauacauguaucaauuuuauauacacuaaaaaucacaagcauuuggagaaagaaauauuuuuguaaauggcuuuaaauuaucuacccauuuauuaaucgaaaagacaucaccgacuauaauuuuuaucuuuuaaugcagcuaaaugaguuagcagaugaucugucuugcuuaguacuuaaaacaggauaaucuaacgcuagaaaauuucaaacucagaugcaccuuguucucugacauuuaacuucuuucuuuuucauuuaggccacaguagauuauaaacaagccuuuagcuucugccaucccaguguaagcuccaagagggcaagauuguugccucuucuguuuccuacuauucaccuuccagaauggugccuggcauguaacaaguguucaacaaauacuugguaaauaaaugagugaaugacacucugcuugcuccugaaaccucaggaugcuucuucuaucuaggaauauuccuucuguacacuccaaacggcccacacugagaaccaaagaaaaguaauaagaaagaacagaauuuaaauuucacuuacaggauuuuaacacuuaaguuugaaauccccauaaucuggccaucucaauuaccagauaggaacaaauaaaggugguaaaggaauuauuagaacaauuuuauuaguuauuuuauauagccaggaggaauccaaaaaaaagugauuuagaagauuaaucacuuuaaccaguuuuacugaaaaugauuuaaacaauucauucucaacagugauguacuugauguuaacauaguuuaaaaugaguguaaaauucgaagauuuugaugguauaacguugguuugguuugguuuuugaagucuucucucaaaauucucaaaacugcuuaauuauaugcaaaacccaaauugggauauggaauuaauuuucuuucccuaaauaaaaauucuuagugugcauguguguaaacuucugauuuuagacccucacagggcagaauccaccgcucauauugcccguggaccccuaagucagaacguuaucuccauccuccucugacaagugugucauuaguaauucacuuaccugagugaggauaguggugguuccaucuguagccucgacugugagguuguaguuugacuucuguucugcaucaagagguuuggcaacaaugaugguuccaguucccuuguccacaucgaagugacugucguaguugccaccuaauuuggggaaaaaaaaguaaaaacaggucacaggauaacacucuguaguuuauucuguggcuuucucauacuuaauggcacugaaaaaucuucuaauauacuagcaaagagcuuccaaggaggagcauuuugaaagaaaagaguggccaauuagaaagacaaugcuuguuaaggcaaagugaacccuaauuguccaggaagcaacuaacugaaagaaagcaagaaagcaacucugaaaacaaagacauugcuaauauugccaaugaguuacuuucaauuugcuuuuucagggguucugaauuccucuucaauuuguaucucaguagauaccaucacugggccauuuaaaagcuuacuuacuaacaaaacuuucugauacuuugagcaaauugaccuaauaaaauagcuauuaaaaaucaauguuaacucuaaaaaaaauagcggucguuaacuuuaauuaguccuggcuacuauaaacuauuugaaaagaauuuuuuuucucauuuuugacaaacacaaagccuaaugaaacaaaaguuucuauccuauuaauauuauccaaauauuuuugauaaaacucucuuuucaaauccaucgaccuagauauaaaaugaaaugggaugaaaauagagguuuaaugucaugaugaaauucuacuacuaaaucuaaccaagaaacaaaacaacacacacgacgucuuaagagaaaccuaaaaccacggagcuaggugagcauuacguggcaacacgcuggcgagugggaugggugaccaugcgcacacuaugaaaaaaaaaacagcgauggaagauagucacuggaaauaaaaaaguaaaaaaaaacaaaaacaaaacaaggcuuuuauuuuagaucucauaaucugaggcaaauuaugugaucucagcagauaccuucugcuguacaggucgggucacaagucaucugaaagauguaaaaaacuucucuagcaagcgugucuccuggcacagccaaaaagaagcaagcgcgcauggaaagcaagcacagaauaaaagcaaucaaucaaaccagguccaagcacagcaagguuacacagcgaggucagguacugcacagcagcagccuguugaucuggaaaugugauaaaaguuaacagaaagcaaacaaacgguuuugagcaucguuaacuacgaaaauagucucuuuuuccccuucccuugaaaguaugcuguaaggguuucacaggugcugaugacaucaauuucacacaaucaccaaauugguaaaacagccaaagcauuuagcaugaaaguuccaaagguaaggccuggccuggccugacaugcccaguggucuggguccaucagcugcaacuuuugggggcuucggguuagcaugacuaaggggcagaaggggaaaaauggacauaaagucccccccagagagaugaaucgcaacagagacucuuguucuuaaauacccuuguaacuaaaaugugaggaaacaauaaaaaaaaaucuaagaugcaaacucuaaugugaaauuuaaaaaauacguugaauaggguauuacauucaaugucuuaucuaaacuacaugacaaauaagaagaagaaauggcuuuagcaaguaaacuuuacuggaggaugaaauaaucuaaugaauccuccuaccuguugaaaaugagguaauauaaaacuaaaaacccauagcugguaccauaacuuuguaccauaagcugguaugaaucaaaauuuguaagcuuauucccuauuaaauauugacaugugacagucacacaggcauaguuacuuuaaauguuccaaucauauucacuaaaaauaacaaugugccauagguuaugcaucaauaaaaauaacaaugugccauagguuaugcaucaauaaauaaacaguaagaagcugugcuucuggaccaaaacauucaaggcuuuugucuguaacucuuugacaaacuuuuacaaaauuuuauuuuuauaucaauaacuugguagaauagagcaccuauuuuaagcaaguuuaacauaugcuauauauugugaaaaauuuugcaaucaaaauauuauaguugaaagcaaauucuccaccugucgaucuuauucccaauuuuaaauccugacuugugcccaaaacucaucaaaccguaugcagguucuccucaguguaacccauacggacaacgaaaaugagggggaaugcuuaccagugaugucaaaccaaagggguaugccaggaggcuccacagauauuacuccaaucaugugagcaacggggucacuuuccaucacaguaaagguaaaaaaugauucuucaaaugaaaugggcuccagggacgguuugggcuuggagauccauucaauauggagucuggugguugaugacuuuugagggcgaccauugucaacugccuuaaucuacaacauuugggcagaggggauuaaaaacagcaaaucaggaguuacaacccagaaaugaaugaagcacagacugguuuggucuuaaacugagccaauuucaaacauuucacauuuguauucuguguauggaaugccugacagaagaacaaugauuucaugaccacauucaacauaaacaauaagcacccugauucucaaacguuauccggcauugccuaauggggccagcaggucacaaacacuucagccguuuacaaaauagaaauaaaguuacuaaagaaaaaauacaaaauaagguuuauagucacaacauaugaaaaauuacaguacuacaaucuuaacucacugaaagaauaucauauucuccagcugcugaaaaccucuuggacgaaaccacuccaguuuucgguucgaugaaaaauuugccaugcucauucccgucuucgaugcuguaggagauuucugcauuggggcccucauccuugucgguggcuaugacgugauagagcggcucccgucuggcauuucuuucucggucuggcuuuucccgcucagggagucugauuuuguagaacuuuugcagaaacugagguuuguugucauuuucaucaaggauuuucacaaugacucuugcaaugguugauuuggggggacuaccauugucugucacaguaaccuguuuuuuuaaaguuaacagauuaacauguuaagauauacuauauaaaaagugagcaucuucuuccucaugcuacuccgcauguguguaaagcucugcauuuugcagggcacgaugacaacauacacagcagaucuucauuccaacaacagggcuguaaggaggugaggcagcaccucccaucucuacagggagagagucagggggccgggcauggcuaagaaagaaacagcugcaccccugcgcgccuuccugaccacgcaggcucucuucucgcauuaguuuaaguggaaagugaaccucacccaaauguuaagcuaccaaaaacuuaauaccuuuaggccauggaagagauacgugaagauucugcuuuacacauuuaaagagucuucuuaaaaacaacacacucuacauacuuaaaaacaaaauuuccauauaucauguuaaaaauguuaaacuucaucaguaaaauaugcuaaauugucauuuuaaaguauguguuaaauaaauaguacaccuuuuaauaccaguaaucaccauuuuauuuuggcuguuuuccucuacagauuuuuauaggaguggaccuaaacauuuaaauuuaagaccaacucauuaaauaagauuuucgguaaaauaacuuucauuuuaaguaaacuauccauauauucuuauauucuauuuaggaaaaaauaucagagagucuugaggacugcacugaugacuguuucuaugucccuaagagaccauuucacccuuaaaucaaauguucacguuuacgucaaugggcacauuaaauauaacgacauuaguaaugcuuauucuccccuauccacaccccuaccuucuucccaacugaauuaccaaaacacuaaaaacggucaaggagacugaagucuggcaguuguaaacccuguuuauuaaagugugacuauaucccgauggugccugucaaaaguauuuaaguaguugcuuuauauuauuuaccuuccuaagcuuuuucaaaauaaaacauuacuauuuuaauuuuaaacucucgaaacauuuccuuuucaucaguuugcauaugagcuuuagaaaaacaagaaagagaaauacaagcaagcacuauguuuuuuaguauucaucaccaaauuguuccuaacuuuggguucaagaaccaguagcuagucacagcuuucaacauguaauggagacacuaucuuuaagacagccaaaucaaugccagcacuggcucucaaauauaccaccccaaaaggacccuacugaaaaauacacuaauuauguauguugaagggaaaauuuauuucccauccauguccaaauaugacuuucaaagugcuauauaucugguaucugcuuccaccuagccuuugauauucacggagaaaagaggacucuggagugacguaugcaauuaaugugaaauuugaaaggacuggagcaaaaugucaguguaacuacugcucuccuaucuucccaucuguuuaucuuugucagugacugcauuugccccuucugucaauccuuguagugacagaaugaaaauucaaaacuuugcucuaucauaaagaaaaugaauucaagcgaacuuuacacccuaugaacuaaaaacucagauguaauacaugaagcagcuccuaauggggaaagcacuguggcugugaaaccaccuuuuccagaggguauucccaguucccaaugcacacacacacacacacacacacacacacauacacugcacaacuauaaaaacuaaguauuuacugacaacguuaagaaaauuugaccaaggauaaaaugaaauuaagcaggcagcauuauaaacagcaauauuaaaagaaauuuucaaaaguuacaguuuagaauuuugucacuuauacuguuagaguggaagaagagcacugauaacucaauuaaacaaaggcagguggccuuuuccaaggcuggcuccgauaaugaacaccagucuuccacacgggacagagagaugucucuacgccccucucugcggucugccugucucucagccgcuuccugacgacacggcccagagaucucaucaaccugauguccauguuacgcuccaccuucccucuccaaauuacucgcggccuuuuucugcaauguauuuacuauuagccaaaaaccaggugaccaauacaugauaacaagcuguggguuuucuaaggacuaaaaggcauuguaaauuauccaugagaaugagaagccuuauuagaacuuucuagaagagcacaucugagacuucaaucuacuuuuacuuuugagguauuuaagaagcacaaacuaaguaauucauaguuuaaaacgcaaaaauaaugcaacuguuuaagagcaaaaaaaugaaucuggaaacaaauuaccucuaguuaaaaagguugaaacagaucuauaaauaccaacauaaauauaucucaaaaacauaauaguaaggggaaaaaaagauguauacagaaaaauaucacuuauguaaaugcaaaugaauuccacaugacacuguuuauagaucuguucgcccccugugugugcgcaagcauaaaauacaaagaucugaauccggcccaugacaguggcuguguauucugggaaugguauugagggauaaaggggacaagagcuauauucauuaacaauuuccuuauauuccuuuuuccuaacaaccaguaaauaauauuaauacaacaaaauauuaauagcuaagaauacugguuaaugggaacaagauuguucuuucccaugauacuuguaacuacgaaucuuuaaguauuaaagauaaaaaaaaaacuuaccucuaauauguguucaucuugcuguucucggucuagcuuccuugacguaguugugaugagaccuguaaaaugauaacaguucauuaauccucacaaaauaaggucaauuacaaaauacugcaauuaaaaucacacucuuggccaggugcgguagcucaugccuuaaucccagcacuuugggaggcccagggggguggauuacuuaaggucaggaguuggaggccagccuggccaacaugaugaaacccuguaucuacaaaaaguuagccaggcaugguggcgcgugacuguaaucccagcuaauugggaggcugaggcaggagaauugcuugaaccugggagguggagguugcagagaucacaccaaugcucuccagccugggcaacaaagugagacuccaucucaaaaauacaauaaaaaacaaaaccauacucuuguaaaagucugagcaaauuucuucucaagaaaaaaagaagaaagaaauuucuuacuaaagaaauuuaauuuccagguacgguuauuuugucuacaaacaacaacauacuuuauacuuucucacuuuaaugacucauauuggauaaaugacaaauaguaagaaaguggaaaaacucaaaucaguuacauuuucuauuuguuagugguuucaauauacauuuugucagaaaagauuuuuuaaaagugagaugaaguuauccaggauuucaaucucauccaucuccuuuaacugcucaagagauaacugagaguugacagaaaugacuucuauaacuauauuaauaaggacuauugaaaauaaaguguuaacucuaauuuauuaccuuugaauuauccacucucauaaauaaagaacuguuauaaaaaguaauguaauuuuccagguaaucuugcucauuuaauuucccauaaaagaaaauuaaugauccucaaauucuguauucuagaaaacaaauuuccuaucaaacuagaauaucuaugaguuuugaccucucuugagaacuuuaauaacugcucaacugucugcauauuuuggaacuagaaggcaauuacaauuuauaaaauguauucuuaugcuucaccaaaaccacaaacaaaacuccccuaagcacuaaaaugucguccccaaucuguguugauggugaacaggugcaugcaggaugaucugcaccuccgaccuuaaaaccagguggagccuguguggcaggacaaucaccagggcugaacguucuccucccagugcugcggcuuuuuucucauauggaaauaccuuaaauaauucacauuuaagaauagacauuauuaaucuaauuuauuuucucccauaaucuuuacuaauuucacagaacuaucacuuaagggauauucaacauguuucucugcagcaauaagugaaaggcuuguguuuucacuuaauucaaagguuuuuuuccuuaaguaguuacuaagaaucuaaaucaacauuauuuuccucacaauucaacgaaacaguguucucuuuuuaacaagggcaacagaaggcuauaucauaccuccacacugggguuuucccagaucauagguauagauuaaaaggugcuaaagggaaaugcuucacagugcuuacggguguaaaaaugacgcuugaauguggcacaagcuuaauuuucauuagucaaaaaccuuuuaaguuaaucucuuuuuuuccccaaucaaaaauguaccauccucuccuaacugugguuguaaauaguucaggaacgacaaggagccccuugauuagucccacaucuaauuauuguaauguguccaccaagaaguugugauugaugguaacaucacguggaauagcagcuugacacguucccaggaaaacaguauucuucugcagagcacuuaaucacucaccaacagcacugcgcaaauacuuaugagcaaauacaacuccccacuucacgauuuacuuagagcacacaagaaggcuaaggaaagcuguaccuguguccauacuaccaauuccacauaaaaaggcugggcaugguggcucacaccuguaaucccagcacuuugggaggcugaggcaggcggaucaccugagcucagagguucgagaccagccuggccaacauggcgaaacccugucucuaccaaaaauacaaaaaguuagcugacaugguggcacacaccuguaaucccagcuacucaggaggcugaggcagaagaaaagcuugaaccugggaagaggaggccacagugagccgagauugcgccacagcacuccagccugggcgacagagcaaaacucugucaaaaaaaaaaaaacaaaauccacauaaagccaaaaggcuaccugaccaccuccuuccugggucugaaauuauuugcauguucuauacuccucaaauuaauucuccuccguuaacucagauggagcuuuaauuucaucccaaugcaaugaaugguaauauuagccccuuucuuuccacuucagccugagucacugccucacccuucaguuuaaacugaagcggguuuaaacuuuuaaacucacugcagggccuggcguggguuccugcugcugcauucuccaaguucuaauauuucuucuaucauaauauuacuccacaguauuaaagccccucauuuaaaaauuagucuucuuuucuguacuggaaaacucacgaggacaguggcugucuuucuugcauagcuugcucacauagcuaucucuccgucauccucaagaaacacuuaaacgugugaacaugugaauuucuuaaaacuaugaaugagcagaauuaaaaauaugugcuagagugagagagauaaacuacuguaaaccugaaaaugauacaaauccacagcccauaagugagccaacagagaaugcguuaguacauauuuauaggcagcgugugccaggugcugcgauggguggcuaggugcugcaauggguggcuacgugcugcgauggguggcuaggggcuggcggcacccugcggguauuuagaagcacagacccgaggcgcagggaagaagcugugggcauacagacaggugugacucagaccacacccacagaagugagcauaauacuaaagagaacagugggccuauaaaaacgguagagaaaauagcgggccgaucuucaaccuaggaagcaaucugcuggaagagaagcuucgugucccagaagccaaaggcagacgauuuuaaggaggacguacuuuggaggagccuggaagaaaagagaaagugaggcaggaaguagaccaggagaaguauuacuuuuacgaagacgagauugucucacauguaacuguaaacuagagagaagacgaagauguagacuuccacuaacaaauacagucaccacuagccuccugagaccaguggaauuuaaauuaauuaaaauucaguaaaguuuacacuucaguuucucaaucacacuaagccaaauuuccaggguacggcagcccccaggggccggugacgacagcauggagcaaggcagauggagaacgcgcuccccacggcaggaagcucugcuggacggcaccggucuacucaggaggcauaauucacaaaucaagauccugcaagaaacccugcaggguggguuuacuuuucugcggagaacacguaagauauuucagacugacaaaaacaaacaaauaacaacaacaaacuuucuuucuaaauucacaacacuuagcaaaaagaaucuuagcaaggcugccguagugcuuuucccuaaugccaucuccagagagaggccgugcaugaguguccuauggggguggcaccaggugaugcacccccucugcgaaaaauuacaguaaaauuagggcuuccugugggauuuucauacaaaaugaaaacagaauuuccuaaugauguaauuuaauacuaggcauucugggugucuuuucgaggugcgcuuuaccuuacagcaaucaaccacacugagugccuaacaccccggggaacgcuacccgaacccccugcacucuggccauacaagacaaucuaccgaguguguucuguguucacacucauucacgccucugugagcaucacuccugcuccucaucccccccccacccccacccacuugaaacaucgacuucaaacauaauucuaaaguacaacugcuccauauacccacuacauguuauuaaccuaguagguaguaaguguccuaguaaguauguccacuucuuucauuuucgacaucugugcucaucugcaauauuuuuugccaaaucccagaaagauauauacuuaaaggaaacuguacagaacuucagaacuagacagaaaccuuuaagauuaucaaguugagcugccugaaccaaagagaaguuaaaauuuuccaaggccacuaguaagucauuaacaaagccaggaguaggauuucguucucuugaggcucagaugagcguuuuuuucucccuaucacaccugacugcguaauuugcuguauuauaguauuucaacacuccaugaacucugaacugugacuuucauaaacuguaacgaaaaaaccaggaaugacucaucauuagucauuuaauagauccaaaaaagcaaguuaggagauaaaagaggcaaaagcagaaaaacguauaugcaacuguuuucuuuuuguaacuuuguguuucaucuuccucuucugccaagcacugauaauuaaaaauagaaaggaagaaaaacuagaaauuuuucuuuccuugguccagaaaaacacugcauucuauauaauaaaacuaugauaaauguaggugggcugagacagcagacacaguauauucucaccaaugagcaguuaccaguucaccccagaaauguaugcacaaugcaguaacaaaguuuauggcacuugaggaacaucauuaaaaaccacucauggccuuucaacgccacuuagacauuuagagaugaguucauuuagaacagagagaaugucagaucagcuauguuucaauauaaaauugugcucuuugacauuucuuauaaaucaguaacaaaaccaucuccaaacuucucaaaauucaagagauaaaguagacuucgcgaagcagauagacguaaaagugaacaucaaaggacuaguaggugaagacagucaugugacaugguccacacagcuggagcgaugaaugcauucagucaacuguguuguacuguccacucagaaaguggagauaagacagucuuguuugcaagaaaccaggaugaaggcuagaaguuggcaaagacuacuuuacaugugagaaacaguaagacaggauagauuguagggcacugacagaaaacacagugcaggagcuacacacagaaaacaggaagcaggaggaaggcucuugccagcaacucuguguuccagaaaaguguggacuugguuggaagagaagacacguggucuagucauucgugcugcuccaccauugccugacaugugagugaggccaccgaggaccagcuggccaccagccaagccugcacaagaguggaagaagcacccggcagaacccuaaauuaugaguuauuucaagggcggaagaacugcccagcagaacccuaaacuaaauuaugacagcuauuucaagccacucaauuuugacaguuuguuagccaagguauuaugcuuuaauagauacuucauuacauauauauauauauauauauauauauauauauauauauauauauauauauauauaugccuguaaaaaacugagauauauccacauauguauauguguauaucuucacauaugauguguaaauaugugaagauaucuccauuuuuacaggcuuagagagauuaaguugcuuacucaacgucauuuagcaaaguauugaaguuggggguucaauaaaucuaguaagucuacauuaaaagugaaagaaaccagggagggacugaagacugugguucuguaaaaaauaaauuucaacaucagcacaguggauaaaaauggauggcauaaucccagcacucugggaggccaaggcaggugaaucacuugaggcuaggaguucgagaccagcuuggucaacauggagaaaccccaucucuacuaaaaauucaaaaauuagcugggugugguggcgugcaccuguaaucccagcuacuugggaggcuaaggcaugagacucacuuggaccugggaagccgagguugcagugagcugagggcggaccacugcaauugagcuuagguuacagagugagacugucucacaaaaaaaaaaaaaaaaaauauauacacacacacacacacacacacacacacacacacacaugaaagauggcagcuagaaaaggaaaaaaauaggauuucugaauaggauucagguccaacugcaacaagagagcaagcacuugcaaucuguaguacgagucaucgaugaccccacacugaaagacaggguccuggcucuaaaggaaggaaucucugcagcccuauguucaccucacccggcaggaaauuuacuuggaacacuuuucaauuacucuacuagagaauaagcacaggaagggaaaaagaucaaggaaaaaagguaaaaaucuggucacccgauaccuuccuuuuacucugauuauuuuccucuacccccugcaaugauuuuggccuuuccgcccuuuuauuuuacaauaauucaugaaccacagccauacacguucuagaaaagcacuguccaacagaaauuucugugaugauuuguguguucuauaauuugcacuguccaauaugguagcaccuggccacauguggccacuaugcacuugaaacagagcuaaugucaccauagaacugaauuuuaaauuuaaauaauuuaaauuuaaauagucaccaauuaugucugauccuuuauagcaucuccaauuucaaaugcugccugucaaaacuaaaaacuuuaacaucugcaauauucaaaauccuuuucugugguuaaaauuugaagcaaaaaauauuuaucuaaauccaaauuuuuguagacaucugucuuaaaccuacauagaaaaaaaaaaaaaaaguaaaacuuuccuagauuuugacugugcugauacugcccugccaugcuccugcuccccguucucugcuaugagucuccacuuggcucagcgggcgacgaagaggccugcuuuagaauugcugguguacuacuucaccugaacacguaccaaucaagaggcucugugcuuagcugugacuuggagaaucaugacucuacuaauuuguuuuguuuuugcuucuuuuuccuaagcacuaaaagugacuaaauuaaaucuauguucauaaacaguaguaaugucauaauguuuacgaucucagucacccacuuguucacugugcacugucauucaacugcucagaaugcuguucccaaaugucaccaugagagacauauacgaaagccuaagacaaggcucuuguccucaaaggcauacaauuuauuuaaggaaacaacuaccacauguaaaaggcagaggugaauauuaaacuguccucucacaguucgcuuuuuagccaccacuaauuauguguuucccaagacccagcucugggguaggcauuuuauaugcgucacucucacuggauacucacagcaacccuagaagggagcuaccaauacacacuaccuuuauuuuuaagauaucugagguuuagagaaguaaaaucauugccagcuaaaugcaaagcugagauuugaccccaagucugucugauuccagaguccaagcucuuaauucacauagacaacucuaaauguaucaaucauauuuaauauguauaaugauuauacaacaaaauuauucagugaucucacuuucuucuaggauuagaauguucucuccaccaagcccagcuccuuuugcaggaaggaguccucugggcuccaucccuuucucacgauguuguauuaaucauagcauuauucugacaaacccuugacugcaggcacgcacuucagauacauaccauuuucacccgaugaugucucugaaacacuuucauauauucuacuugauacuaaguuuaagaacuguaaucauaguauuuuuggugguaaaggaagugucuaguuuaaguuuuagggucuucaguguaauuucuucaggaguuguuacuaccaggauccggaaguuagauuucuacccuucaauccugacuguggcagggacugcucccagggacauucagugugcuuaagaaucagcaacauuaaggacaauuacaauaaaacaccuguaauacacucaugggcggacugugaaacuuacacuguuuggguaacuuuuagacaaggagcacuacaaaaaccagcaaggcaaggggcugaugagacaugcauauguguguacggauguaaugugugcacaaacuccugugcacagaagcugugacacguucaacccugacauauuacuucuggcuacuccugggaaauggaacagguagcuggagggaagagaggagagaggagggaagagaggagacaggagaacuucauuuuauacacuacuuuauuguggccaucuuuaaucuuuaaugggcauauuacucaaauaaauuuaaauauuaaaacauuuuaaagcucagagugaaaauauagacauauuugauggcugaaaacuaaacuuaggcuggaaaaucucaaaucaauuauuuuuuaagccuuauauacacuaauauauggccacacauauaaaaaacucaaacuccuuagaaauauugaaguggcauauccuauaugacuuuuucuaauguuuuugaguugcagcaaauuuuuaaugaaauggaucacgggugcuaaguauccucuuacuguaaaaauaaaguuugcuaaagccagagggucuuucacgaugcucuagcccaaauccuguaccuuaaaacaugaggaaaugaggucuaggcauguggaauaauuuccugaaggucugagucagcaggagaaacuuuccuaccaaggaaaguguucagaaggcucuacugcucgagccuuuuccugcagaggugugcaucgggaucauggggugugaaugccaaccccccuucuucccgcuccaugccagagccaccaaaucacacucuccacucaugaggacccagccuguaccaucucaugaagguuucccggugauuccaucccaugcugaccuccucaguacaggugcugacagaaguugaaaaaaauucacucuuuuuuuaacaguuuuguuuucagucauuauaauaauuacuacuggacauauucuggaacaaagcauauuaucuauuucuuuaaaauacuauuugagauacagagaaacacaauaggacuauggacauauaagaaauacacaguauuucucaaguaugguucuuaaguaccauaagaagcauaauuaacauugcaaaaaaugcaacaaagaaguggccgggagagcccaccugaagauuccaucuguucuucaacugcuuauuaaguccuaaaacaucacccagaaucuuccugacaagucugcaacuaccgaccaaaucauuaaagccuguuagaacaaaaguuaaaugaaauguagucuuuacaacauuaaaaaaauuaagaggaaucuaaauggcuauauacauuuccauugaacagcauauuuuccgucuucuuggaaauaccuuugugguggauugaaugguggcuccugcccaaaagauacauacaacccuggaagcugugagugugaacugauguggauaagcaucccugaagauguaauuaagaaccucaagaugagaccaccuuggauuuaugguggacccuaaauucaauagcaagagucuuuuuaagagaaagguagaggagauuugagucagagacccagggaagaaaggugucugaugacagaugcagagacuggagugguuccgucacaagccagcagguuccuggagacugggaggagcgaggauagguccuuccuuagcgcuuucagagggagccaggcccucacggcaccuggaauucaaacuccuggccuccagaaccgcgacagaauccaccucugucguuuaaauuuauggaaaguagccuuagggaaauaaaccuuuuuuaaaaaaauuaauggcuuuauugagguauaacugauauaccaaaaacuacauauguuuaacauauacaaucugaugagucuggauauacauacuaauacaccuuuuuauuuggauagcaaaugaaaguacugaaaaaauauuuucuaaaagaauuggguaacacuggugaacaauuccauuauucagagauaaccacuuuuauuaccuucuguauuuuguuagugucuucacuugaaauguuuuauggcuugguaggcuuaucacucuacacacgagacaaaaagcagaggauuaaacaaguaacucagcuccaaaggugaucugggaugaaacaaaauucccaaguggagucaugcuuucccucaggaggaggagagagcaggaugccucggcucuggaaugggacuuccuuaacaucucuggcugagaaccacaacucagcuaagucuuuuguuuucaguuaugaauauacaaaauaugacacaaauuauacaucaguucugaguauauuauuucucauauucuuuccucuccauaacagaaaaaaaacucccuaaauauugacuuaguaacucuauuaauaauuauacauucuagcuucaugccuguaacacacaaaaguuccaacucuaaagcuguuucaacuaaggaccaagacagaacagacucuuugauucugaguaaagcaaaauagccucucuguccucaagaguucacuucaccagcaacaugggccucaggguacaauaaguuaaucaaaauuuuuuuuacaaaacuaauuugccuaauguuaucauuagucagaaaaacuuaccugugcucacccuguguuuacccaaacuguccuuucgauuuuaaccguaccucuugcuucucuuauacagcagcuaagaaagaacaguaaaaaggccuaauaccaggaaaaaugaacauaaauuacauaaauagggaagauaugagaggucagagauuuaaguaaaagugcuuuagaacuuuacaggacauguguuacaaaucuugggcuccuaaaaauuguuuuaaauguccaugguucaguguugaaagagagcuugcucugaguuagguaagcuaccaaagaacuacagggaccaaccagaugcauggaaaacagagagggcaacaccacugguccagggucaaccaacugcacggaaaagagagggcaacacaauuggucauuauuuugauuuuuacaaugaaguauuaaauaauuaaauaauuuauuuacuauuauuaaauaauuuauuuauuauuaauaauugauaaauuauuugaugcuucauuauuauucauaaauuaauaauuaacaaauaauuacuaaauuuauuuauuaauaauaaauuuauuaauaauaaauuaauaaagcaccaugagcuacagaaauaacagacuguaacuguggaacuccagauagcaccugacugucccuuuguaaacaugucauccauggaacauucuagucuacggaucuguacccaaccagcuuaaauaaaaugaaacggccccagaacaaagcuguguaugugacuuagagaucauggcacaguccugagagcuguacaauggguggacagaaggcgcaagugagcgggagugacagaaacuacaucaagggcagcauuugucugugugaacugcuaugccuccucuuccaaugggugaaagggaaaauccuucaaauguggcugcuuuuaaaaaucuuucaugaguaucacgccugguucugugguggauacaauaaugaaugaaggugguccuggcccauaaggaccugagccaacacuggauccccccgaaacacacaccagagccaacacugaacaugcagagccgacaagccgacuaguccaccggcagggaggcgucacguccuccgcuucugcaaaacacagauugccuugcuggccacgagcaaacacgcagcuucuccuucacuuuaucacucagcacccagccccucagagcucuggacugugagcucggagaucuccgcagcaccgcaccgucuuuacucaggugguguccuaagaccacacgucacuacagccggcugcgcgcucuuucggcagcuguggccgucucagcagcuauuguuugucccugaaguacuggugccggcaggauuaggcguggagccaaaaauggaauucuauucauagacuggcgaggcuggaaagcagcucagaacucauuuaguucaaacuuucagaguuccaaagaaaacacuaauaaaauggaucaaacgacuagucuaaagucacauggggagucauacagggaccccauacccuagucuucagacgucucuucugcuuucaauucuaccuuacuagcuguuucuuguugaaaauugauggcauuaaaacauaagaucgacagcaaaacucaauuuacagggaauugccuucagugauccuauaaaugucagauauagcagggucagaagaagaggauaggguacacaacccauuuuauaagguuaacaucauguugacauaaaaagacuaaucucaggcacccaaaugcaaaaucuuaacuauaauuuuagcaaauaauauucagcagcuauagaaaaaccaaaugcugacagaauuuaucacaaagauucaaguuaaccaauuugcggaggaaaaaguuugucaucaucaacaucggcagaaauguacugaauaacauuugacuucuugcaaacuuuagggaugauauacuucacuuauuuuauaaaauaauaaugagcaugagaaagagauaggaaaaaaaucuacagauuccuccuuaaaauaucugcguaucuugguaaaaagacugcaaauagguaauuuuuuuuuaaaugaauuccugccauugaaaugcgacuggcccguccuuuccuuccuuugcagcuaucaaauguuaccggaaaccccuggaaguuguuugcagcuuuagcuauuuccuauugcaguuuguucaguauucguuccagccacaauaaaaugccauuuacucugguucagaaaaaaauaguuguaaaguguuacuggacuaacacaugaugagcacccaguauaccuaccagcuauucuaccauuuuguaacuuuacugcgugcuuuagggauuaccacacauaaacuauacaucgcugcccagucugcaaucacaaaucacauuuccuauaguaaacauaaaauaauucuauacuaaauacaggauuuuacauguaaagaagcgaauaaaaaacagaacacuguauaacgccguccucuaaaaagcauaugaaauggaaacugaguaauuugaguauaacaugucgacacagaauaagagaauaaacaaaaugggggagaugauaaagaccugcuaaguauacuuagagccaacuguuugagcugaaauugggagcucugaaaacuuaacaggacacaucaacacagaaaaaguaggaaaaccucaaaaucuaggaaaauuuaucuucuaaugagaaacaauuacuucccaauguagaagagaucuaacagucuacuaaccaacuugcaaaaucguaucugagaucucaaccuugauacugauacucuaauugcucuauuuaaagaauaauuuuguuauuaacaaccaagagaagugaaauacaaacauccuuucuaagcacucuugcuuagagcaacgggagggauucaauuuuuacuucagaaauauaaaagucuaucccuucaaaauaauuuuaaaaaucagcaaucaacgaaauuguuuaacuagucccaccaguaaauacguccacucaucaggagucaggaaagcacaguagcuuguuuuuguguggcuggcuagugaagaauggcuuuugcauuuuuaaaugguugaaaaaaacuuuugugauacaugaaaagggcagaaaauucaaauuuuauugaauuuauuucguuuauuuacaaaguuuuacuggaacacagcggugcucacucauuuccguaucaucuacagcagcuucugggcuacagugacacggcugaguggugugacagagacuguauggcccacaaacccaaaagccccguguggcccuuuauagaaacaguuugaugaccccugcgguacaugcuucauaaaacuaaguuuaaaaaucuaguguuacuuaaaaguuucccauuuuuggucugauggcaccauaggaauaagauuagccugaaaagcaacuauuauaugaaacagagucccucaaugcaaagaguagauaagagacagaaaaacuggcuccacaaccacauuuacacccaaaugcaaaggcacagggacugggaguggcaccaugcacugagaagcggcagccaggaaauucacauugccugaccucugguagcucugaccucugugaagucuuagauuauuuguaaaaugaagaaaauguaaauaaggagcacagcaggcuauugguaucuguagucaccaucucacagggcucuuguaaagaugaagucuguggaagcugcucguaauagaugagacacacuugucaauguuccucugacuccuaacgaaaguucuguuccagcccuauccaaaagugauggcaagacacaguagacggguggaagagugguauaaaaaaagacuucagagaaugagacagaaaggggcaaaacaaggaaaauuaggcuuugcugguuucccuugggcuaucuccuucaagcucagcucuccaagggaacaggcaugagacagcugauggaccagcaggaccagcaagauucuaacagugcaaugugcuccacaauaaugagaugggauuuugaguaaggaucacucuccaaaauacaugaaauuuuuacucuacagguugggcgcaguggcucaugccuauaaaaaucccacuuugggaggccaagaugggaggauuguuugagaucagaaguuggagaccagccugagcaacacggugagaccccugccucuacaaaaaauauaaaaacuagcuggucgugguggugcaggucugugaucccagcuauucaggagaccgaggaaggaagaacuugggcagaggaguuugaggcugcagugagccaagauggcaucucugcacuccagccuggacgacagagugauacacugucucgaaaaacaaaaaaaaaaacaaaaaaaacuucacucuacaggauggaggaaggaaaaccuaagaaacauuaagcugaaacaaacucaaaacacaaaaccuccauuaagaagauucacuauuuaucaaaugagguuuuuaugguauauacauauugaauuguguacuaugugauugcauuauguauuuaaaaucucaggaagacagaaauacagguagcagcugucaaagagccuaaaaccuuuuaagaugcaaauauagacacacagaaaucacaaacauacauauauagucaaagaggaugcccuguaccauuaacuacuaaacuuuucugauaaauuuauuuuuagucauaaauaaauuucuuucuuacuguauuuguucucaaagaggaagaugaaugagaagagguaaaaaguaaacauugguuagauaaaaucaguagaccagugaaauggacagugaaagguacauggauaugcacauauauuccuauaauaauguggcaaguucaucaguaaccacaauaaggugauuuuuuuuuuuuuugagaugcaaucucacuguugccuagguuggagugcaguggagugaucucggcucgcugcaaccucugccuccuggguucaagcuauucucaugccucagccucccaaguagcugggauuacaggugugcaccaccacacccagcuaauuuuuguuuuuagcagacaugggguuuugccauguuggccaagcuggucucgaacuccugaccucaagugauccacaagccucagccucccgaagugcugggauuacaggcacgagccaccacacccagccaaggugcucuuaaaagcacagcauccaauacuguuauggaaaaacccaagaugcauauccauguauacaguaugcuaucuguauaaaaagaugaggaaaaaaccaacauauucuuucuugcuuauauacaagugaaagaaaaugcaaacacuaguugccucuaaguagauuuuauuauucagguauggugaggcaacagaucagguacgaccgccaguaccugaaaguaccugcaaaggcaguuugguacuuccccaagaggaggccauaccaccgccacugaagguggcaaaggccgaaggccgugcugggccauacgggaccaugccaggguuggucuggagguggaaggaaccgggaaagcuugacugaggaucucacagaaaggcaaggugagacgcucaggacuggcugguuuaaguaauuucaaaggcucuggggcauagcuguccccaguugucuagcacuggcucugauaugacuugggcgugacacagauggugguguggagugggacucuggacuggucagcuugcauaugaaaagcacgguccugcaccagucaucugcuaucccgaguccuggaaggggcaguccuuccccacucaaugagggcccagaugccacagcauucaggauacagaaaauaagaaaagagaguuaauauacuaaggaagggaacggagugucuggagaacugggugaaaguaaaaccugacuggguaucuuccuguacuauuugcacguugugccaugugauugcauuacccauuuaaaacaagugauagaauuuaugaggugugcuacccacacauacacauacaucacaaacacacgucacaaacacacaucugccuuccggccuugcugagcaggguaaacugaugaugaaugguaccuggggaaggaggacugagaagugccauuccggcuacuggguacaacacaacagcacaauuugggagggacaaaaagugcauacauaucuguauuuccacaaacuccagaaacauaaccaggauauugcuaaguuucgauuuaaaauaaaccuagaaauucaguuuuuacuccaagacacagaaacccugguuaagaagauucacuguuuauuaaaggagguguuuacaguacauacauauugauggcacuucuaaacuuaaaaaggcaucuuuuucugauuuaaaagcaauagcugaccuuccacuucuaguaagggaucagauuuaugcuuuaacauaaaaccaccaagaagcagacaaaaugaaugcacuggcaguugaaaggacacuagacaucaggcaaagaaagacaaggaucccugagagaaacagaugaggggacacccacgaucgcagcagcuuucugccuugagacaguuuccagacagcuaugcaccccuaugugauguccaagagaaauggaaguauguguccacagaaaggcuuguacucaauguucacagcggauuuacaaacugccaaaaacuggcagcaauacaaaugccuauuacuaggugaguggauaaacaaauuauaauauuaaucuaucuauauaaaggauacacagcaaugaaaagaaacguagucuugauacacgccaaaacaugcaugagucucaaaauaaacaugcgaaguauaagaagccuuaccaaaaagaguauaugccaugugaguucaccaagauaaaauuccaggaaaugcaaacuauuauuuagugcuagaaagcacaccagcauuugacuagagauggaggugggaggguugggagggggaauacagagaagugugaggagaccuuugggaaugauggguguggucacugccugauaguggugauguuuucucagguguaaaagcuaugugaaagcuuaucaaauuguagacuuuaaauaugugcaauuugcuguaagugaauuacaccucaaaaaagcuuuuuaaaaauaaagaucaauacuugguuuguagcaaaaacgugaaaaauaucaaacauacagauaagagagcaagaccauggucucuucuaaaggacacacaugucuaaaaguaacacuucaaaauuauuaauaaaugccaauuguaaguugcauaucaacucccccaaguucaaagcaauaacuuuaacuaaaaagacucuuugcaaggguggugucgauuucccgagguuguucgugaauaaugagucaugagaagcucacacuagucucuuuuguuugggacucccuuucuucucuguccuugacacaccacaaagcugugaugcuuuuguuugcaggcgcugcagcugccaaggcuccaaucugaguucuaugcuccugucucucuuccaccuugagcaagugcucaacuuaaguuaaaagaagcacauuuacccuguaacugaugauggacacagucaaacaaaaaauguuauaaaaauuagcaaugucaacaaaagugcauauaucacaaaaagagaauggaugcggucuuucacuuguaucuccuaaaaaugaaaacccacugccccccuacuugcaaacaauauaauaagaaugucugaaaugcagacagacaguucuuggcaccauaauuaagcacaaaaaccuugaagagaaaaaacauucaaaaaaguucacucaaacuugugguuuagaacacaaaauucauaagcucacucacuaaacccacuccuagaaagcuuucuuguugugacuuuuaaaauauuuuguuacacuaugacaaaaggggaaggagaaaaagauauugaggagaugucucccucuuuuccaaaaagacuuuuauuuaaguuuauccaaaauguugcaaggcaguuuauacugacucaaaaagaggucacuuuuauuaauaaaaauaacaaauauucucuuuaacccuuauucuggcauucgagguuuuccacugaggguagccgucucccauacacuuauuucuuggucuccaacucaccauuccuucaaauugucgccgacaugaaaacaucuccuaccuccucuccaucaaucuauuguuaccaucuucacaaucagcccaguacccguuccaaggggcucaucuucccaacauaaccacugccaguuucccacuuccaccggacccgugagggccccugccacgccuccaccggacccgugagagccugugccacacugcugcacacaucuguucuucuugguuauuucacuuuuguagaugacgaacuuucaaagauuugguaaaaaaauuucauaguucgguaaauaaacacggccacgcacugcauaacgacgugucaguuaaccacgggcugcauauacgaucgaaccgcacauacgaccgugguugugaaagauuaauaccacauuuuuacugcaccuuuucuacauuuagcuauguuuggauacacaaauguguuacaacugccugcaguguucgguacaggaucacggcauacaggucuauagacuagaauagaccaucccauacagccuggguguguaguaggcuagaccaucuagguuuggguaaguacacucuacguuguccacacaacgacaaaaucgccugaugacacguuucucaaaaugcaucccuggcauucagccucccaugacuguacuugaugcauaaacaaaugcuuuaaaugaugauaacuguagguauucucuagcugcuggacguuuaggauaaucaccagggucccaaauucauguuucuaagaaacaagugggcccacuuuauucuagcaaauguguuuauccaaaggcacaaguuuaucagucuacuagauucuugauugucugacauucauuaacagagcaaccguaacacccgcaagaggaagcggcuguggcaccuguccccugaacgacgcugggcgcuccugcacucuacacacacaagcccgcuguggcacuuguccccugaacaacccugggcgcuccugcacucuacacacacaagccggcuguggcaccuguccccugaacgacgcugggcgcuccugcacucuacacacacaagccggcuguggcaccuguccccugaacaacccugggugcuccugcacuuuacacacacaauccggcuguggcaccuguccccugaacgacccugggugcuccugcacucuacacacacaagccggcuguggcaccuguccccugaacgacccugggugcuccugcacucuacacacacaagccggcuguggcaccuguccccugaacgacgcugggcgcuccugcacucuacacacacgagccucaacaggggacagaaacaccaugaaucacaaaaucgaaggaccuggaagucaguucgccccaagaucccagagggaaggccucacuaugguccggaucucuggauuuccagcccagugauuuccuugcucagccguuaaucauuaaguaacacgauuuagggucuccagguggcgagaugggucagugacucccaagcacuauuuccuaccggacggacuuucaucagccuucacaaucaggccgccaugauacugaccuaccugggaacagucugcuuuaaagguuguaagaagacgaggcauguguacuucaggcccugaggaucacaccccaacuuucugcugaggugggggaagagaagcaucuagaaacagaucuaaugaagcuauauuuacuauauuauuuaauaauuccaugcuaaaauacuguucuucaucuucagagacuuuaggugaucuguggaauguugagacuucuuuacuaaccacagaguuuuuaacauacuucacaacaaauacugcuguguacuaacuaugguauccuccacuauuaccugacuucaacucauaaggaaagaaagccucugugugcauugcacugaauuuccuccugccgcccugccagcggagugccugugcucccgccggggcugggguguggcuguggacaccuggagaggguuuauuccuucugaagacaacagcacagacaucucugcaaacaccuuuucuuuagaguugucagaauagagagauuuaaaagggagaggcaaugccauauuaaucauguuucuacaacaagacauaacaccauagcagacacaucaucauuucuggggucccaggaagaaccaaggguuuucaaggcuccccacagcaaugcuaagcuauauaaucuccucaguuucuuucuccuccuacuccucaaacauauauuaugcccagaccuaugccaugugcucagauaucccaaaggauauuucuugcuugcucaucuaucucuucacagaggacuuacucuaaucuaaaagagagacagaagacacaagaaaauugaaaacacugcuuagucuaauucaucaaacaaauuacuauagggguaguucuggucuugaauugccaccugagauaugacauauacguguguuguggggagggguacauauuuguuucuguccaugguuccuggcucguuaacucccagaaccccuguuagucuuugguuauaauguuguggcacuuuuugccucaggaaacagaaucucucuccgggccaccugccacucuccuuucaccugccaaggcaggacuccaaucugacugugugucauaagccccucauuccagagagggucccgcuccauauccuggaggcggaaacgcugcagacagaggccaagaacaaucucaagagacaggccuuugucaaccacauguugacauggcuguccgugcgucaaucaugccuaggcaaugaagucuccauaaaaggcccaagaaagcagaguucagaguuucucaccgcugaacacguggaggcuacgggaaggugaacaagaacucauccaggugccgggagggugguacacccugacucuaccgggacagaaaugccugugcgugggacccuugcagacuuugccccuguguaucucuucaucuggcuguuuauuugcauccuuuaaaauauccucuguaauaaacagguaaauguuaaguguuucccuggguucugugagccgcuccaauaaaguaacagaacccaaagagaggucaugggaaccgucacuuggagcuggugggucaggaguuucggaggccugggcuugaagagagguuaugggaacccucgcuuggagcugguccgucaggaguuucagaggccucggcuugcaacuggugggaagaagugaacacucuugggaacugagcccuuaaccugcagaaucugaggcugucuccagguaaaaaaaugucagaauugaaugagaggacucccaagguguccgcugcuugguguguaggaaauccucccccccgccccccggccagccccccaaacacacacuuggucccagaagucuucugugaugaugauuguugagguuugggaagaggguaggaaaacaucucuuugaggguuuuuguucacacucacauugugucaaucaaggcuuuuacuucuagauuucucucucuggaggucugggaccgccacuagagaggcauacauacauucuggacuccaaauucauccucacaauucuuauauaccucugacuuuucucuuauguuugacaaugccuuuaauuuuucaguacuuaguucuuagcucacuuuugcuuuauuucacaaggagggugaacgcagucaccacuugugcaguaaaggaacaaagauuagaaguuuauaaaaauuucggaggaggauuuugaggucauggagcuaucuucuuggaagcagggaagucagucacagacaucgauggaaaaaaauauuagaagcaaaaggccuggggugucacuucaggaaaguaaccacuuccaaucugaaaacuguucaaucccaaucccuuaccaccugcagauacagcacugcucuauaggaaacacuuaaaacauuaaaaaacuagccaacugugaaauaaacucuuuuaauacucuuuacaaaaagccgacuuaggacaauucaaauucuuagcagcaguagaauuugcuguaaguuuaagauauaucacuaauuuaggagcuauuacugaaauaacaauguuugcuuuuuaaccugaaagugaaacccuacuaaugagcauaaucguaaaauagcuuuauaaaagcaaacucaaaguuuaaaaagcacauuuaagcuaauuuuuuuuuuuuugagauggagucucacucugucgcccaggcuggagugcaguggcaccaucucggcucacugcaagcuccgccccccggguucacgccauucuccugccucagccucuggaguagcugggacuacaggcgcccgccaccacgcccagcuaauuuuuuguacuuuuacuagagaugggguuucaccauguuagccaggauggucucgaucuccugaccucgugaucugccugccucggccucccaaagugcugggauuacaggcgugagccacugugcccgguuaugcuaaauuuuuauccaaaauaaaggcuuauuuugaauaauucaaaaggaaaacaauuuaucaagaaacaaaaguauguaacagauaaaugcuaauucuuacuuuucccccuaacagaaaagcauaagcauaaacauuuccuauagcaguauuaacacauaccuguuuuaggauguauugaaaagaauccuuguggauuuccacuuguaauuuuguacaugagcuugucauuagagcucgaaucuggaucaaaugccucgaucuggaccacagauacaucuuuaggagaauuuuccaugauuucuggguaauaaacaggcucugaugucuguggugcauugucauugacauccucaaccucuauguagaucucuaugaacgaugaaagaggcacgacacccugaucgguugcaaagacuguuagccaauaaugggaggucgauucacgguccagucgaucugacgucucuaugacaccuacagagaaaaaagaaaagcguaaagcagcacaucaacgaccaaaacugccagcuucagaaagugucaacaacuacggcuuacugagagcuuuauaugucucuuacuaggugcauaaccuugagcagguuaaccagccuuucugugacucagcuuccuuucuucuaaaauagagacaauaauaguauauucaacuaacaugcauauaaugauuagaacacuuggcacauaauauaggcuauaaaaguauuuguuauuagaaucaggugucaggcacuaaauggagcacuuuaaaaauauuaucucacugaagucucaaaauaggugagcacuaagagaucaucuaauggcccaacacuucauuuuuccauagguaaaguuuauaguugguugagagacgugcugacuuuccuggaggcuacucaggaagacagggacaacaccagagccauggcccagaucugagaccccacaguccagcacccccgcuccccacacugcaucccuguggcggccacugucuaaggaaaaaggcaggagcagcauccuccagaaagcucggucugcacacacaccccuucucacaguggcuaaggaaagaaacugcaaccuucaaaguccacaauaaggggcugcucagaucuccugaguguugagguccuuuuauuucuuucaaucgccucaaacaaaugggaagacaaccagcaugcuauaaaaauauaaacuacacuauaaacuccaaaagggcagaggccacaucauucuuaaauaccaguauccgcagcaccuuacacaaagcacaauaacguauuaaauacacaagugaaauaucuaaguaucuuaaucaggguugguauagaaaaguccucaacugggacccaaacuaggauacauuucuuaguaagucaacuagcaagagaugaaauuauaugauuacaaagaagaggguuagaguaucuguaauguuuugguccagccacugaaaccagucaaaacuuaacuucaagccaggauuuaccuccucuggggauaagaaguagaaauauccauuucucuuuggcaagucccaccuuuuuauucaauggugcaaucucgcccuuugucuaccaaaaacauaucacugcacuuuuucucauggauugaucacucgggacuaaagauacuuucaguguucuucuacaccaugguacaggcuggacucuggaaaugcugaagcucuagaaucacugaaguuucccguuaaacgcaaacuacugugagaaaaauaaccaauuaccaauuuuaccuaugcucagcaaugaaacauuugguugagaaaaauacacuguugcaauucguaauuuugaucacacgaaauuaaauauuaacuuauucgagguuaauaucagaaaaacucauuuuuugaaugaaugauaauuauaucuaauacucccaaaaggacucacaacuugaaaauagaaaacuuagcuaaauaaaaugugaaauuaucauaaaaugaaucuuuauugccauucagaagcauuacaaugauuuguuauugcuucauuauuucauacugaaccuucagaaaggggguauaauacugcuucuagaaacauggaagaaaccucagaaccaaaugguauuucuaguucuagaucccugaggaaucgccacacugucuuccacaaugguugaacuaguuuacagucccaccaacaguguuaaaguguuccuauuucuccacauccucuccagcaccuguuguuuccugacuuuuuaaugaucaccauucuaacuggugugagaugguaucucauugugguuuugauuugcauuucucugauggccagugaugaugagcauuuuuucaugugucuguuggcugcauaaaugucuucuuuugagaagugucuguucauauccuucagccacuuuuugaugggguuguuuuuuucuuguaaauuuguuugaguucuuuguagauucuggauauuagcccuuggucagaugaguagauggcaaaaauuuucucccauucuguagguugccucuucacucugaugguaguuucuuuugcugugcagaagcucuuuaguuuaauuagaucccauuugucaauuuuggcuuuuguugccauugcuuuugguuuauugcggcacuauucacaauagcaaagacuuggaaccaacccaaauguccaucagugauagaccggauuaagaaaauguggcaccuacacaccauggaauacuaggcagccauaaaaaaggaugaguucauguccuuuguagagacauggaugaagcuggaaaccaucguucucagcaaacuaucgcaaggacaaaaaaccaaauacugcauguucucacucacaggugggaauugaacaaugagaacacauggacacaggguggggaacaucacacaccggggccugucgugggguggggggaggggggagggauagcauuaggagauauaccuaauguaaaugaugaguuaauggguaaagcacaccaacauggcacauguauacauauguaacaaaccugcacauugugcacauguacccuagaacuuaaaggauaguaaaaaaaaaaaaaugaaauaaaauaaaauaaaccucagaaccaaauaaaaaugagcuaacugguuccuccguacagcagacaacugaagaugaacucaaacaugcuucccuguucucuaacccaagcauaaugcacacacacucaacuggucugcuaaauuagcaaaauuauaucugucuguaggcucaaauaauaaccuuucccaguuccucugauucaucacaucuauccacagauacaaagacgucaggggauaacagaauguucucuccgggaggauuacacauuaacaaaauguacacaacuccuccugugugcugcuacuucauuaaaaugcaauaaaauucacuugacaggugaaguauuauuagaaaaucucaagaagacagguacguggugcuuuuaucuaccucuuuugaguucuaauccuccaacaauucaugcuuccaucuacuguuuuaaaaugugccccucuaaaugugacuagaggcauuuacaaacagugauaauuacagaaacaauuugcucaguguuuacuaaaugccaggcccugugauaagugucuuacaugcauuaucuuauauaaucuuuacauccaaccugccuagauaugugaugcuauuaacuccauuucacuaacgaaaaacucagauugagagaaaugaggcacuuucccagggccacagugaauggcagagcuggagugugaauaccacaaaucucaucuucagcgccagcaauauccuugucaguccuacggcuguuaugacaaaagaguaaacaaaacuuaaugugguaauuugggaaagaugagucaaacuuccuauuucauccaccuguucuacaugucaguauucagcaggaauguauuaaauguucacucauacacaauagcuuucucuaaucucaagggaaaaaagaauuaugaaauggaaguauaucacccucacaucugagguuugcaauuacagauagaaacagcuaugauuuuuccgucgugccuuauuucuaguucgggccguaagcguccagacugcagugugcaauucugagauggcaucugcugguccccaccgacccaucagcuguacaaccagggggugggggacagucauguccaucaggaggggauugucggccuccccgguaaucuacggauauuacuaaagguuaagacugaggcaacaaagcgacucuauucaaauaucggagauuguguaauucgcaauuaaaauaguaaguaugaaugagugagaugcuggauguuccuauuucaugaauucaugacuguguacuuuuauaaugccuaucgugauugcugagauaagcuucugcuucgaugcauuuuaauuauuaccucuuuguaagauaaaaaaucacugaauacaacuuacggagaacuauaaaguaaauuucaacugccaaagggagaggagggcacaccgaagaaucuuaucuucuaaccaaaauccucagaucccucauguccaccaaucacgucacuagaugcuuuaugugcauuaaaucauugaaagaacauggaaguugcaugauuuucaucccagcuuuacacaugaggaaagagaagcuuagauccauuaagaaacuugcuuaagcccuggagugaugaggaaacaaggccagggucaacagcuaacuggugggauccggagcugagccggacagucugacuccaggccucagggucuucuccacugagcggugggcuguugccacuaucaaucaacagcaacacugucggacaccaaaggugcuggggaccugguggggcuauaaccaugaggaaaggccacaaggaguuucccaguguggaaggaagggucuuccucaugcaugcaggacaacagacgggagacgaucugaggauuccgcucagaguuuugggguucaguaccuaggcgcuauuauaggcacugcacaaaguggguggaaggaagccuuaagcgugccaaguuauuuuguuuuccgcuuuuuaaucugucagcccaguugcaugauacacuccucaagaacccugggcagaaacuuccaaaguggaccuauggcacuagcccgagaucucuaggucaaaaccccgaagcuucccaucuugaaucagaggcaagacgaagguccaggauggcugagugagagucuagauaaugugcaaagaaagaccagggguagagcuagccuucgccaucucaaaaucaagcauuagacugggaacgccuucaaaacccuccagugcaacucccuuguucuuaaagaacguugaaaugauuuguccaacuccaagaagcuaaacagguguaguucagaauccagagugaaggacuuccuuaaucagggguucaucacgauccaaaccauucuuuaagggaguccugguuucugcagggagugacacaccagcugucuccaaguaugaccgaagcugccuuuacucauuaagucauuagcaguucuuguuccuacacuucaucaugcuuucaccaguccuuccuaaagccacgacuggcauuuacagauuacagauugauuucuucuguaacuuuagcaguuaccucaauuccauagagagaaacaaauuuucacauuuccauugggaagacuucuaauuagugccuuuaacacagagaaaaacaaaaauaaaacuaaagacauccagucaucacuggaugugaaucaaacuguggucacucucaaaccucuaucccugucuauuucucuuuauccaugaaugucuaccuaucaacuuucaauaaguacuuuuuuauauaguggguuauaaacucacccuggagacaaaaggaaccaacaaaaacuauaguuuuuacagguaucuuucuauuuacacauauucacgaccucaccuuuuugggcaccuauguauauccacccccaaacucuucucugcggucucccuccugucuucggcaucuccuccccucugcgcuccccuccuucuaccuuucugaaagcaaacacagcaugcggccagaaggugccugcgcccaggcugugaggagggagggcugcagcccaggccuuccgcaggauucccuccagccagaugccgggagcaacagagccgugagaggggugacagggaaacucugucgccacucccgucaggagguugccgugcacacgcagugagagcggucgugaugcugcugcgugaugcuaugacgcagauuuggagcacaggagacagguugagacacgcuuguuacgugugccacucagcagugccaucagaaaucacggcuuuaccugaaugaagcauuacggaaggaaugaaagccuagcuuuccaaccucgagaauacagugaaguuguuaauaaccugaaaaauccgaaagaagccggaaauuuggaguuauuaaguaagaauauuuaucauuccaaacauacucuccaggauuucaaaaccaccaccagaugucacuauggaaacucacuuuaaauaugcauccaguggagaacgagacugaagggggaaaaauguaauuucuaaaagagcuuaaccaagauaguugaaaauagagcucacagcaaaauuucuguauggaaggauucauuaauguccacuuacuuaacuaaacggauacugacguugucuuuccacagccugauuauucaaagguuauaggguugcuccaauaaacgguucaaaaguaaaucacaguuuccaauaauaacuccuacuccccgccacugcuggccccugcugcuguuaaggaauaguccuugaucaggaaaggccagcauucccucccgcugacacagguggaacaggacucuugcaacacaguaaucuuuaaggcaaaaauaaaguuauagcuaugauguuugccaaaaauaauuuaacugauucaaauucccauggccacagaacaccuuuccuccuagaauuuuccuauuuuaacaggucuuggcccccaaucaagccuuaaugccaaggcuuucaacaaagccucguuacuucugacucucagaaauaccuaucaucagcaacaacccagcaacacaaauuugcaaacgcuacccuccuuucugauaugucacauacuuaauguuuuaaacuuuucauacaacugcuuaaggcagcaauuguauuaaaagcugcuuuguucaaucacaagaaaaacuuaaaugugagauauaauuuuaacgauauuuucccuacaggcaacaacagacagaaacucuuuucuccaauucaauacccucagcguaaacaggguaacucuuuugaaaauaagcauuuucccaaauaugaaaacaauacucacggaaaaagaagagacauaccaucaacacacuagagagccaauaucucuguugcugcaauuaaucuauaaacgguuauucaauuuuuccugcuaauuaugcaaagacuaaacaucucagaauugucauauuaaauguuaaucacuaaaaacaucaauucuuccuuaaaauuaaauuuuaaaaguagauuguaagcuuccuauuagaaugcaaacuuuuuaaggacaaagaauuguuacguguuugguucaaggccgggucaauagugagugcuuauaaaaaaugauauccauuacagacaagcaaaggaggagaaacagucgcaggcaagaggagaccagagagacguaacuaaaugucaugugggagcuuggaccacagaaggcaccuuagguaagaacucagaaaaucugcaucuauuauggacuucaguuaguaacaauguaccaauacugauucuuuaauuguaacaucuuacauacucauguaagaugucaacaacgugagaagcuggggcagggagcagggaguuaugugagcauucuacuuucugcuccauuuuucugcaaauguuuuauuuuuuuaaaaaguugucuaugagagcucauaauauguagauuguuuccuuccuucaauuaaaaacuuuuuugaacuuaccuguuuuuaaucucguuuucauuaaauacuagauuuagacugauguuaauauuuccacaucuugaugauaccuugagagccuaauguguguauaagaaacuuuacauguuaaaggcuaaagauuuaaauaacaaucuaauucaaaauauaauuuacuguaaaauaauaaaaaaauauuacuuguuuugccuauuauauacaaagaaaagcuguaaaacgaguuuaauauaaaaagcaaaauuucugcaauuuagccuuucuuuaaaauaacugggccgggcaugguggcucaugccuguaaucccagcacuuugggaggccgaggcuggcagaucaccugaggucaggaguuaaagaccagccugcccaacauguugaaaccccgucucuacuaaaaauacaaaaaaugagcugggcgugguggcaggcgccuguaaucccagcuacuugggaggcugagguaggagaaucacuugaacccaggagguggagguugcggugagccaagacgugucauugcacugcagccugggcaacaagagcgaaacuccgucucaaaaaaaaauaaaaauaaaaauaaaaauaacgauacuaguuugacaugcaguauuaucucauaaaucgaaaccuuugaauucuuuuagaaacaauacaguagaucgugugugugugugguguguguguguguaaauauacauuuaauguucuugcuucugccaucaguuggcaaauuuauguuauuuacuacuguggacuaaaauagaacaagaaaugaaaaaggaggagucuauugggcugaaggcauuuaagauucuaaaauggcuauucagucuacuuucucagggaaugacacaggaaaugcucucagaacuaaaaucaacauuuguuacuuuccuuucaccugaaguuuauaagauauuacuauuuacuucacugguguugcuaaucauaaaacauaaggaauauguaaagaccaauguuuaaugguuuauuuugcagaagaaggaaaaaaacaaguucuaguacuuuuaaaaacaauguucuauuauguguguauacauauauuaauaaauaaaauuuuaauugcuagagaccacuucuauaaauauuuuauguuuuugauaauaaaagaaagucaaaauaaguaaaagaaaguaagucaaccaagaagcaucccucgugggccaaucaaacugcuaggcaguauacuaguguaccguacaggugccucucugcccccuuacagauaaaaauacaguaaaucauguauaauuucuuucucuccaguuuaacugaagccaugacacugaccaccaugacccaaucuuucaaaaccagugaugugccaugagugccauuuugugagaagccauuuguauuuugagcaaacucaguggccugaugaugacugacagggauggcaacauaacagcauacauggacucaagauauagcagagaagaacuucuuauacaucagcucauuuacuccuuacagcaacccuaagaaguagguaacguuaucauauccuauuucacagaaaggaaacagacaguacaagcaaccugccagaagucacacaguccauuaguggggaacugggauucaacccuaaaagucagguuccagacaaucgugcuaaauguuuggagucccugccuguccuucaauuggagggaagauuaaggggcaacugaacacaaccugcaaauuucaccagagaaguugugacuugaaugcaauccagaaauguagcugccagaugccguuuucccaacauuugaaaaucugggcuaaagcgaauuucauuguaucgggagggaaaaggaauggacuuauuauaugaugguacauacacagcuucaaaaaagaagacaugcauauuaauuacacagaagaaugucagugauacagaaauugagagaaaaauauaaacguauaaaaguauauaaaauaugaugcuacugcuguucagaaaaauuuuuuaaacacacauacacaauuauaugugcagagaaaaaaggucugaaauaaacaaggugaucagcagauaaauccauccagugaacagaaacuuuuuuaaucuguaaauuucuguaaccauggauuuaaaaaucuauauuuaaaauguauacaauaaaagucaauuaaaacaauaccugcagcccaguaucagaagguuuuauguacagaaccucccuguuuuauuuuucugucuaugucuuagauguacuuucauuuuuaaguauuucuguuucauuugaguagauauaugacaauggauauucuggcagcuucgauaacuaacacugaaguauuuauguagguaacuacuuacacaaagcuuuaggucuaggaaauucuauaaucacauugcccagaaugagaucauaagucaaugacaaaaggaaaagcaaaaacacaacugucacuguuugcauuauuuagauugccuauuuaaaucauuuuaauuaaaacauauaccuaucaauucuuuuaauuaaaauugcugcaauaacuucaaaauuagcugaggaagcuuucugacuugcaaacuuacuaaaacguaguauuaauuaaguacauaaucagauuuuaagcaucauguuucaagcccagggauuucuuuagcucugcaaagagucauucccaggguaagcucugcuaaaccauguugucccgcuuuguugaggaaugauuccaaguucugacuucccugucagaaucacugauauugucaaugacggcuuuuguggauaagcucuacuguuaaagaggaucacccuuggguaucaaaacuuaucaucuggacaccuguuaauuggauaaaacuacauccacaagacagccuucagaagcauuaagauacagagaauauauuuuaccuaccaauggcaaugcuucuggaaguuuguuucaaauuucagaagauacgcaauuucaguguugauuacucuucuccccuuauacggacuggaugcagacuuaguaaaagcuuuaauaugccauauuguuuaaucuucacaauuagcccaguggucucuccccauuuuccauauucagaagcagaggcuuaaggcucaaaagucacuggucugaaguuauuuacuccguaauaaaguaaccaaugaauuaauggauuaccuuaccaguuagucaucuuagagcuuuacaucuaacaacuuagccugaaaaguuaaggaagucauccucaguuauccaacuuugguagcagagaagccagaaccccaaaccuggcugacuggcuccagaguccacacauaaaaccagaggguacuaucuccaugagaugcagaguugugauucaacagccaggucugacucucaucaaucaaucacuguuaguggaaaaacaggcaacacauccaccaagguggaccagcacuugccuguggugggaggagcgauggaacuuaaguuauaacaacuaaaggaaggccaaacagaucccuguauagaguucaagaacuccgugugaccaggcccauuuaggauaaaaaagaaaaaaggauauuaaaaaaaauccaacacugcucucuauuuaggaaguuacuguguuuaucauaucuucuuuauguauuaaaaggcggccagguacagugguucacaccuguaaucccaacacuuuggaaggcugagguggguggaucacuugagcccaagaguucgaguacagccuggacaacauggcgaaaccucgucuuuacaaaaaauacaaaaauuagccaagcaugguggcaggcaccuguagucccagcuacuugggugccugaggcaggggcaucgcuugagccugguaggucaagguugcagugagccgagaucaugcugcuguacucaagccugggcaacagagugagaccuugucucaaaaacaaaaacaaaaacaaaaaaccugcauaggcuaaauuaacugaaauauacuagguguaaguagguauauggcauuauacuaacaauacugaaucuaacuacgagaauauuauaacugagucuugaauacuguuauuaacuauaaaaaaacuagagugguggguggcagauguagagcucugaaguguaaaucagcuguaaaaguuuuguggcagaucaacagaaacguuuuaaggaaaaacccucuuuaggaaagaaaucucauuaagaaaaaaaaaaaacuagccucagcaugguggugugcccuguaguaccaguuacucaggaggcugaggcaggagaaucgcuugaacccaggaggcggagguugcagugaguugagauugcgccaccgcacuccauccugggcaauaaauaaaaagaaaaaaagaaagaaaaaccagccagauguaguggcucaugccuguaauuucuccacuuugcacucugggaggcugacgugggaggauuacuugagcccaggaguucuagaccaggcugggcaacauggcaaaacccugucucuacuaaaaauacaaaaaauuugccaagcaugguggcacacaccuguagcuccaggcugaggugggaggaucacagaggcugcagugaaccaugaccacaccacugcauuccagcccaggugacagagugagacccugucuaaaacacacacacacccacacauacacacgacccugucuaaaacacacacacacacacacacacacacacacacacacacacacaauuaauuuuuaaaagcuguaccuuauuuuucaacaagggacuuaauguuguuuguacuggcuuggaucuuaaucuggaaccuggcuuuauugauuuacaccuguuuuaauucauucaacacagaaugaguuccuaccacaugccagguaugcuacaaggugcaaaagaaacaaaaagaagagcaaaaugagguccuaugagaagacaguuaaauaaaagaguaacuuauuccuuggaccagcagagagagaggaaaagaagggcaccuguuugagaagggaaacagcauuuuaacaacuagguacuuuaauaauuauuuuccauuuauuguauaaguaucuuuuacacaaagaccaaacaaauccuuucuucaguuaugaguuccugcuugaauuuuauaaugcaacauguaauaaagugauuuuaaaaaaauaaaugucaauucauuuugugaaaaaaaaaaacaaaaaaaaacagggagaagaggauaugcaagaaaaauggcgaguuauacggaugaguuaauuuuaucuucuuccuguuaauauuuucuaauguuucuagaagaaauauacauguauuauauaaaaauauuuuuuaaaccaacguguauaaaggguuaaucugaagcauauaaggagaacuuaaggaauuucagaaauguaaaagcaaccuuuaaaaguuaagagugacuuacagguuuucauaggcugaauaacaacugccuaaagcucuuguacugcaaaguguguuccagcaagaagacaaggcacuauucaaugauuaaaaugucaguugaaaugacuaagccucaugccaaacuccuuaaagcacucccuugcuaaagaaggaauggaaugagauuccuccuguuacagucaagcacuacauuggucucuguauaaacagaacucucuccaaagagacaguugucucuggaguccuagaaugcacacagcugguggaagggccaguuuuccuguuucuaagguuuguuuaggcaccuguaaacagauuauaaauacagaaaaccgcaacuauugcucucaaaauaaacccuaagaaucauaugcaauucaguucuacaaaaaggaagguguguuuuacaugaacugaaugcugacugaagcaaauaaaagucccauugacuuuuuggucccuguggucauggacuguauguauaagcugccccccugcccauccauucccaaguagcauuuuccuuuacuccagccuccacuuuuaucaaauuuuuagaaacuucuuuuucuauuaaauuuuauuucaauuacaaagcaguucuuaaauuuuaauucaaaucuuuaaacuuuaaaaauugcaaacugaagacgaacuacuuacaagcaguguucagcuacuucuaauacccaauuuguugccaaaaccaauaccuguaagaacucagaagcuuaaguuaggucaagcuaaccuaaucaggaagugauucacggacacugauaaccuaggagaaacuucagauauguccuuuuaugcuaacgcuucauauuaaaucaaacagcccuaucuaauaaucuaaaugcacugcaagauuugauguuaaaccuggcuaagaaucuucguuaaggcaaaacaucaauuuguaaaugcauauuaaucccauaacucccguuuucuaaauucaggguuuuuuuuuuuaaugaagaacgguguaucauauaacggaagauuucuaauuuuauauauguuuugaaaucacaaaagagggcacaccuguauguaucaggauucuaaaauugagagguaagcaaucaaaacucaacaaaccuccuacaauacccaguauaugcucagaaacugaacaaucuuaaccaagauuucuuagugguaacuguggggcagacaaaugaaguauuuaauaugcacuauuuuaugcaaacaggaaacaaaucucauaaaguacuuugaaagagaauuaaaacaggaggaaaacggauuacugcuaauucaucacuuuagagacuaugaagacaaaucuugcuggagacauuaaaagacuauauaagaauagauuggcaagucucaaauaacugucauguaucuacauuacuaaaaauuaaagcacagaacugaaacaagaaaaaaugaaaaauagagaauaacugcaguaguucuuauauuaucucuguccuuaacuuucucugagagcaaaguuguucauuaagagagcuguucuuuaacaaaguaauaauaaacauuucauuuuaaagugacauuuucuucuuuaauacuaaccauuaauaaaauaaagugauaacagaagauguagaauaugaaaauaaacaucacagggauaucaagcaguugaugguauuugaaaagcauauauucaaacuaaccacuagaaaaaacaaauucaaaaacacacaaguguucauuauaacacacuaguuguaauuaaguagcagggugguuacuaaaauauacguaucggagaagauaaaaauauaaauaaauagcuaggcgcaguggcucaugcugguaaucccagcacuuuguaaggccaaucuaguaggauccuugagcccaggagguggaggccagccuggccuacuguauuaauuuauuauaauauaauaauaaauaaauauuuauuauuguaaauuaauguaauagaacauuauacaaugucauuauagacaaauauauucuauuaucacuuuauuuuauacauguauagcuauguaaauauauuacauauauugucauuaauaucaauuauuguauauuauugauauuauguauuauauauguuauuaauauauuauuacuuuuauauacauauuacauacauaaauauauauacauaggccugcauauaagaaauuacaggggaauggcaaggcugcggagaaacaggaacgcuuuuacacuguugaagggaauguaaauuaguucaaccauugggaaagacaguguggcgauuccuuaaggaucuagaaccagaaauacaauuugacccagcaaucccauuacuugguauauacccaaaggaauauuaauuauucuacuauaaagacacaugcacauauauguuuacugcagcacuauuuacaauagcaaagacauggaaccaauucaaaugcccaucagugauagacuagauaaagaaaaugugguacacauacucgauggaauacugggcagucacaaaaaggaauuacaugugcccuguaauuucuucagugauuggaacaguaaaaguaccuuuuguuuaaaaaaauauuuaggcugggcugggcacgguggcucacgccuguaaucccagcacuaugggaggccgaggcggguggaucacgaggucaggagaucgagaccauccuggcaaacacagaaauacaaaaacacuaaaaauacaaaaaaacacuaacacuaaacaaauaacacuaaaaauacaaaaaaauuacccgggcgugguggcgggagccuguagucccagcuacucgggaggcugaggcaggagaauggcgugaaccugggaggcggagcuugcagugagcugagaucgcaccacugcacuccagccugggugacagagugagacucugucucaaaaaaaaaaaaaaaaaaaaaaaaaaauggggguugggggaaccccacacaucuggugucagaagcauguucugagagucuaauucaggaaacugaguuuguuuucuauccauaagcaggaaguaucucacaucuuauuuagaaaacugucugcuuuuuccaaaaccuaaauacaaauucaacaugggaaaaaaaaaaacauagcauaguacuuacaacacuguugccauuccuaaagcucaaauauuuccagcucaugacaguaucagauauauggguucaaaaggaaaagcauguuaucaagucuacaguuuagaagaugauuuuugaaaaaugacuuugugcuaaacucuuggauugagauugccuuuucauucagcaauuuaugaaagagguggugaagcaaucguauauuuuuucccacuuauuuuacuacauugguugguuugcuguagcaggcuauuuguuaaaaucugaaacucaagaauuuuuuauaacgugccaucuaaagaacuacuucauaauuuuauaaauucucaaucaaccauaauucacaggcccaguaaacuaaccuguuuacugcuaacuguacccauuaauagaagaccaugagugucuuccaaugcuuucauuaccuaauuggaacagggaaauaucccaaauaucccaacacgacugcaaauuuaaagccucgauuaauuuaaccuaauacugaagacauuugacagaugcucccuugauaagccuauuuugaaauaaugcuggcauaucccuggcuuuaauuauuguccuuaaaaaagaaauacaacucaacagacuaacacaaucuguucaaaagagacacgcaaagggguaccaguguugagaagcaaaggcuaagccauccuauuauguucuucaauaagauaaaacuaacaaauuccaguaauauagcauauaacacaaacaugaaaucugacuaugacugaguuuaucauuguuggugacaccacugugaaaacacugaauaggcuuuaauuacacacgaccguuucuguaacauuucucucuucaggcaccacuccuccccugccccucuggaagggaagaaaaacacucccaaauaccuuuacaaaggcacauguggugggcagccgaccucuuacaugaacacuaccucauaaagcuccaagaccaccguaaguucuaaagcaugguguuugguuaucuuaaauaaucaaaccaacgaaucagcaaagaacaagaguuaaaagagagcaguaaagaucaucuagugcaacccucuaauuuuacagacaaggaaguccagggaauaaaugacuucacaaguuacuagguugcagagcuugaaucaaagccauaacuggaacccaaaucucuugaaaucucagucuacguucgagaguggcaccuaguagagaggugcacgcuugcauuaacacaaaucucauaagacugaaaucggcuuuucugauuggugagggaaauggcucacauuaggaaaagcaaaagucaaugauacuaucucagaguuaaugaucugccaaccaaacccuaagaaagcuuaaaaaauaaucggccuuaccuuaacaugguaucagugacuuugaccuaggcacacaucucaaucacuggucaagaguaucaccgaauuauuucggaauuggagagggaaacaagagugaauguagguuuuauucucagucuguuacuucaaaguauuggccuuauaaucaaccauccuuacagcaugccuguuaacugucccaacucagcauuuuaauaaaugugugacuuuggcaauuuauuauaccucucuauauuuacuauuuauaucaauauuuauuauuccucuuauuuaaaagugggagauauauggguuauaagaauuacuauaaaaauaaagguauuuaaucuauugaaucuauuuugauguuugagaaacuaaagcaaaaccaagauuuaagaagauucuuaaagagguaugacaccuuaaucccuaaccucuguauuuccaaggaugcuauuauucaagacagaaacuggcuacuaacagaaaucacacgaugauggaagcgguguucggaagagaacuuagaaucacuuauuguagagcccaggugacauuccuuaucaagacaagggaccggcauuagcagugcucuaaagugaaauacacacauacgugcagcacagaagaaagucagaauccacagcaacguuguucacugagacacaucgaugaguuauuucaacugacagcguaaagcauuuuuaaccugaaacaguaugcaucaauaccgcugaaguggcagugaggucugccacaaacuuucccuccagccccaaaugaagagcuacuuuuauaaaacguuucaaaguuucauuucaaacaugaaaggacaauaaaaaccaggaaaagucaaauuaggaauuucugggacacagaaaggaacauuaguccaccuuugccuccauaacuaucuuuccccacuuauuuucguuacauuuugucacaacuacuuucucagaacugguuacggaucuauaaguaaagacuaaccaaguucaaaagaagucauugcuagaagauaucaugauuaccaaaauaaaaguaaagcauaauaguucguguuuagucaccaaauauauaaaauuauuaguugucauauggaggcgauaagggacguuggaugaucuccuuaucuaacagcugggaagaaaaccuagguugccacccagauucaggacuaggaaucaggcaccuccuaagauuucuuucaaaauauuauuacuuaucuucugaauugcuaaaaguuguaaauguuagccgggcgcgguggcucacgccuguaauccuagcacuuugggagacuaaggcggguggaucaccugaggucaggaguucgagaacagccuggucaacauggggaaaccccaucucuacuaaaaauacaaaaauuagccaggugugcuggcaugugccuguaaucccagcuacucgggaggcugaggcaggaggauuccuugaacucgggagguggagguugcagugagcuaagaucacaccaccgcacuccagccugagugaaagagcgagacucugucucaaaaaaaaaaaaaaaaaagaaaguuguaaauguuucuaacaugaugcguaugcaugaagacagacuuuuugaacuaaaaacaugcuucugaaagaaaacaacuuuuaaugauuuguuuuuaaaguaguuaaaacagcaaucuuauuucaaggguuuacauccaaaagaaagucuguuagcaaagaggacacugggucuggcaggacauggccacuuaaagaggcagcccggcagaucagaggaggauuuuccuucuuuucuccaugucaucagugacuacaaacaccacugagggccccaagggggaaccaggcagaaagccuggacugggauaaaaccuagcgaugggacuccaggacagcaggacagucagcagcaggaaaaaggaagagugugugccacaaaacggaguccucuccugugguaaggcagggucacucccguguaaggggcccuggacugacugcccugguauuccuaccauucccuucagccacagaccacagccucauguccuggccacgcaccuaccuuaacuaccucaucccagaccuuccaccauacaagcuuguguuucagggcuauuauucccucugauuaaaaauugucuucaaauaguuggcucuucguucuugucauucaggugaccacuccaucuaaggaggccaugcacacccugcaaaaauccuuaacacaugcccuguuuuccuccacagcaccgcucagcugaaacugugcguucuuuucuccucaucucuguguugacucgugucuccucucuccagaagaauagcuccaagaagggcacagcaccauccaccuugcaaacuguggaguccugggcuccaagaagggcacagcaccgucuaccuugcaaacuguggaguccugggcaccuagagcagguucuggcauucuagaggcggucaauaaacgucaacuaccagaugaaugaaugcauggaagggcauucacccaagccuucuuucacccucucaaaucuugccucugugaaauuuuccgaaaguuuugcuuucaaaggccacucgugauuucuccaaagccuuuuuccuuccaggaccuacagcaggacuugcagcugcugaccugcggccccuggagcaggcacacuugccacucuucucccucccacucucauuuccccacaaccuccuccuaggguucuagacuaguccaauacacgacuucucccuguggucauggacccaucaaggaucaccagaauggagagcuucauucugcucccucuggaguuauuauuaauccuuuuggguaucagagaucccuaugaaaaauguaaaagugguuaaauucccucagugauccuuccaaaaagauucagagggaauuuuuuuuuaaucacaaaacauugcauguaauaguuaacaaaacugaguuuuucagcuguuuuucaauagcuacaaaacaguaagauugcuacuucauuaaauccaccgagccaacacacaggcauuacauaauucacuuauccaaauaauugaauaaguaaauuaacaguuuaaauagaacuauaaacauaugcuuaccuacugaauaaaauaagccaggauuuuucuuguuuacuguauuuaagaauguauuaaaucuguaagaaauucuucauuacauaggagucuuaacugccaacucaggucauuaugaacuauggguauuugacaauauuaaacuacauucucuuguuguuuaaucgucucaucuagacugaaucuccucuccaauuauaacuauauccaaucccagaugaaggucucacugcacaguuauaggagugcuuccgugcuggacccugggaaggggaugcuuuagaagggccaggacaguaucugcgaggggcugaagguacucuugcagauuuccugucggcucucguaggagacguaggaccaugaacugugcuccuccccgggaugcaccugccuccgcccgaacacugccaugcacagaaaauggaacugacgcucggcccguuuucaacagaaugaaacagcuaccacauuucuuuaggacacuuuaaauaauuaccauguauuuucuaaagcaacuaacauuccucucacaagugaaugacuggauguuaaucacuaacuugggggauaagagggaaaaaaaaaaaaacccaaacucccuuuaccccaccaguauuaacgcagcacagugaaacacuuucagacacguaauacaaacaggguaacaauuguuuuaauuuaacaaauuuaaacaaaaacggucaccucuggauagggcguaacauauuaaacagaggaggcgugguuuucauuugcuacucuguuuaguuuugacuaacuggaaaugcucaucucuucuuauuucggcaacuccuuuuaugccacaaccaagucaugaauucaggaaggaagcaggcaagucugauuugugcaugaaacauuaucuaaagggaagaaagucagccagugcccucgcuaaucccuugggcaagaaagguaaaguauacagccacagucucaaagccagagugacacaggaguaaccaggagcgcacauuccugccuuaucuggcguuacuuugauucaccucaccuuucuuucaugacaggaagggcacuccaagggcauuacacugagaucaaacaaagcauuccagaaaggcaaaggcucuucucacagggaaaggaagaauaagucuuacauuucaugaaugaauaagcuguaacgaaacauuucuauauccuuaaauaaaauguccaauagcugauaggauacggaaccguagagaacguuaaaccaccaccacaauaagagcaacuuagccaaaccccucuauuuuucaguaacaccauaaaauauaugaagguuaaaaauuccuaucucaaaugaaacaucuucacuaagauuuucuaaaauucacagcagaguuucuaaccagcauauguggccugggguugcuuuaguguuucugauuauauuccuuagguaaggauuacgcagucaguauuuuuugacucugguuaacuuuuccuuugacugcaucucagagguuccuuuaacuuuucaaagcacuuaaccagugguuauuuucaaccugcauaaugcuuucuacauaugguauucuacaauuaaaacauaacucugauuucuauaaaaccaacauacauuugguuacuguaaaagacagucaagacaucuguaagagacucguauucccuucaacugaggugagcauugcucucucuacuaaaaaagagaauacuggcagguccugagcuuugcucuaucugguagguugcauuuguagaugaguccgucucuaagcagccagcaagcuguaagcacaccgguugugagaaucuguauaaggaaaucuacuucccucaguuaaacucucuacaccaaaguaaauucaucaaccucagauuccuacucuaaauucuuggacucugacucacuuaugacaauccuggaagcuggaacucaaauaucuaugggcagucagcaaauaaaggccugaagagcuguaaucaaccaacuguuccauuaaaacagacaacuacugucugguuuagaaaaauaauggauuucuuacuuccagaugauuaaagaugcauucauuugguacugcugccuuuagaagaguuccccauggugcaggaaggcagaaaguuugugcaccauaauuauuugagaauuuucacccccccccgacauucugaagaaaacauguagcgauuuuuuuccugcauucuuccuccacauucaucauuuuauugguaaaucagacucuauauugcaguuuuuaugagauaccagaauuauguaaguaugcaacacuaagcuaaugaagaauaaaauaugugucaauuuuugaaugaguguucuuuuuuccaagggcucaaugaaagcaucuuggcauaauuaaaucaauauaguaaucucaacaucugggccugcucuguugaaaugcaacccucugccucaauacaaaucucauuuuaauauuuaauuauugaaucuauugccuaaagucagcaacuuuaaacugguuugcuuagcgcuguuuuuuuuaagcuguucuuuucccaacugcauugugaacagaacccugugccuuuuauccgccucauacucuuuuccaaguucuuaacaugaauuaauagcugccaaggaacugcuuauugccuaguaucacauccuugauaauguguucucagaugaucccaugaaacagucuaucuguuuggauccaaucacuacacugcugauuauacacuauggacacaggugagugaauuaacucauagggauacuugggaaggaaaagagaacuuauauucuugauuucaacagcaaaauuacauuuuuaaauuuaauuugacaagccugauagcagcgaaaacgaaaaauucaacuacuucugauuuuacgaaguagcaucuggccaaugaaaugaagagugaaagcauguuuuacagucuguccaucccucauuagccuuuaucuggcauacaagagacgcuuuuuaaacaauuaauuaaugugaagaaauaagccucaauaugcacuggggacaaagaucgagaaaagguaaguuaaaucagagaauaugaucccaaaaaguuggguuauaaaaaucagaauuuuuaaacacacaaccagaaccacagccacaaaacuaacaaccacuguuucaauuaugauaguucccugacugaauuaguauuuuccacucauaaaucugccaucauuuugauuucuguuucuaaauccaaauauucaguggcagcaagaaugcagagaaaugggcacucacaaacugcugaugggaugucuaguucucauaaaaacaaacaaacaaaaaaaaagaacagcuuuuaaaaauuucauuaccuuucacccagcaauuucacuuccuguuauuuacgcuaaggcaacagagauacacacaaacaaggaacuuacauauucaaaaauugaguauuacuauacaaacaggaugagugucccaaaucaaaaaaucugaaaugcugcaaaaucugaaacuuuggagcaccaacauggugcgcugggcauuguggauuucagauuucuggaugugggaugucaacugguauaaugcguauaucucaaaauccaaauaaauccaaaacacuucuagucccaaguauuucagauaaagaugcucaacuucuauuagucugucucugugcuggcacucuauauucuaaaaaucacauucuuuaagaauaccuaccaaccagaaaauguucuggauauagcagaaggcagucaacaaaacuacacguucaguaaauguuuucuguucaucauuuuuacaaaucccgcaccuggcacuggaaaggcaucuuugugcagguacauaugaguuaggggaaaaguucaccaggguucuagguaguaaaauuuuagucauguuuucuccuuuccaguaguuuacauuuucccaggcuucuacaaugacuauauacugccuuuuuauuggaaauaaagaucauuuuuuuaaugaggggaguucgcuaauucuguccaaaugcuauggagacucaaagcugaaaaaaaaaaaaaaaaaaagccaacacuauguaaucauuuccaaauucccuuuucaugaccuuaaaugggacuucuaaagcuaagcagaugccccagcaggaaauaaauuugcaacucaacagaggcacccacagagauauggcaagaugcaccuucgguggcuuuggcaauaauuuccuuucauuaugugugaaggaaucuucacucuccagugcuucucaagucaaagagaagccuguagaaguuaauagguccuuaauauguaucugcucccugaacugauuccuguucauaagguaaucgcggaccccaugugguccuuucacaggggcuucggcaaauccccugcagugagauggccccugggcagcucuguuuucugcagaccaggcugugaccuaaucaauaggguuccaagcaagacaaucccuacauucaacagcucggaagaaaugaagggggacgcaauucaagcuuuauugacgaauuccauuuaccugucacaaugaugguucacccagcaagaguaccccccccgcccccccccaaaaaaacacacacccuucagcugcuacaguagacuuuccagccagcagccggcacaaaauaaacauauuuacuuaagcuucagucacaacucuugacgugaaacugaugaagcccaaaugaaacagguguaucugugagauacaaaggcagcagccacaauguggcaggguagguuuucauaaccuguauucguuuaaacccaaggacacaaaaaguaccgcaauaaauauaaagcagaaaaucaccccagcaugcagaucccaaaauuuacauggaaaauuccauaaaccugaaaaugaccuuuuuaacucugaaaagaauaaacaggccauugaaacaacagaaaggucaaguuuacagaaagcaacuacuuuucaaaaagaagugugaaaagcauggguuuugaauuaauuauacauguuagcaauuguggaagcccacagaaacuuuacaguuaaugaauaaagauuucacuucacuuggaaaugauggaccuggucuaaauaaaucuuuuggaaaaucacucuguaaaaauaucacuuuaagaugucauauacuuucacauaaagaagauuuguaucuuguacgucaaaucaaauuagaauuaugcuacaaauccaaauuaugccccccaaaaagcuauuuaaaugagggaacuucaauaacaaauguuuauccucaaaaagacacaugauuuacucggaauuuuacaaaagcuaucacuggacauuuuuuuucuuuuugcauucacauccaaugacccaucauggacaauuuuuaauugaaaacaaagucugauuuuaaauuaacuucugggcuguuuuuccacacucauuaaccaaagcgagagagaguccaagucaaaagacuccaaaaugagcucacacacucgcuuaacaucacaagaauugcuucacuguaauauuuuuaaagccaugccaggaucuaggccaccagccucuucaacaaauaaauuuucagcaacaccaguguaauaggcuuuuaacauccucauugaauguccuuagcccaggguaucuggcacccacccacaccaggcuaauucaacaggcagaacuacuuaacucuuccacuuccuuucccacaagggcaugcacacccgccacacgacucgacuccgcacaccaccucaccugggcgaucaagccuugcuuuguugguggugaucucuuaauauccagaggaaaauuaacacaccaugugacucuuuaaaaagacuaccgcacucacaagcccauuagaagaucucauaccuacuuuuucccaucacccaaaugaagggaaagaguaacuuuccuaucauuuuuucucagguuuuaguagccccuuccucaguuacuauucaauuacauuuucccuaucccuauaggauagcuacaaauaaacaaaaaacauguuacugcauugcguuacagaaaaguguaguagaauucaaagcuguauuucucuaaaaagaaacauuuuaaaaagaagagcaaacacuugagacuacagagauaaauuauacuuguuaggcaugaagccguuaucucaaguuuacuauucauuagaaugcugguaaucuuaggacaguugaggaaguaaaaacaaucagaaacaaaaccauucccaccaaccccaaaagauuccagcauagguaauuugcaaaaaaauuauaaccaaagugaaugaucagagacguagcucuaggucacuuauuucguguacgucauucacagaagaaaaucuaauagccugcacgguggcucacgucuguaaucccagcaccuggaggccgaggcaggcagaucaucugagguccagaguuggugaccagccuaaccaacaugguaaaacuccgucucuaauaaaaauacaaaaauuuagcuaggugugguggcucacaccuguaaucccagcuacuugggagacugagguaggagaaucacuugaacccaggaguugcagugagcagagaucacgcuacugcacuccagccugggcgacagagugagacucugccucaaaaaaaaaaaaucuaguagcccacuauccaaauuuaaagucacaaauaucuuuaaggcaguugaacucuacauaagucucuaaacuugcauuugaaauggggcuagucgaaacugaaauuugcuguaaggguggaauauacacugauuuaaagacuucauaggaaaaaaugaauguuaaaggucucauuaauacuuacgcuaaucacaugcuguaauuguacuuuuugauauguuggacuaaauaaaauauauuauuaaaauuucaucuguuauauucuuuuuuauuguggcuacuaaaauauauaaaauuacaaauaaagacaguacuauugggcagugcugcuuuugaccuguuauacuaauucauuugauuuaaaaaauaacgaguaacgguaaaaaguggcagaauuugcacaauuuuguuaauauaaauuguaaaaaucaguucaccuuucacauaugagcaccuguaucuaaaaacaguaaacuuuggaauauuucuaauaagugguuucauggucuacucugggacaugaaucacuguuguguuuuguuuuagcuuauacagaguacaccgugcugauuaggugccucuagugcagauucaucucuaacaccaaaagaaacaauuuaagacuuuuauucucuucgcuaacaugaucuucuauauacuauauccaagacuuacuguuuaugagaauaucacauuuuaagucaccaucucuacauuagguuucuaacaaaguuugucaacuaacuuguuacagaaucuucauuucauuucaugagaaaauuuuuuguuagaaacaaggccacugagccaggcgugacaggcauguuggcucacaucuguaaugucagcgcuuugggaggccaagguaguaggauggaucacuugagcugaggaguucgagaccagccugggcaacauagcaagaccccaccucugcaaaaaaaguaaaaaaaauuagccgggcaugguggcauaugccuguagucccagcuacucaggaggcuguggugggaggauugcuugagccccggaguucaaggcugcaguaagcccugauugugccacuguacuccagucugagaaagugagaucccaucucuaaauaaaaacaaaauaaaauauuaaaaaaaacagaaacaagacgauucguucugacauuuaaugaucacugaaccuuucuacaagcaguaaacaauaaacauguaugcuuuacuguggcuacuauuuuuuuuuaccuauaauaaugauuauuuuuaugugguucuuuuucuaaucucuuugaggagaagaauggcagcugggacuuacuacuucucuaaaaaucucuguuaaagaaggccacaaguuuguuuuucuucccccccauguauaugucaauguguucaaagacauccacucccaaaauuuccaaacagaaauaaugucaaaaugcuuagugagucaauacaguuacacguuucuauuucaaauccuaagauuucuauuucaacuuaccacagagcacuuuccuauuaacuguugcacauacgucccguaacaaacaacucuaauauaagcuaaaauuagcaaaauacuaagugguauuaaaauacaucuuagguuauuuauuuauuuauuuauuuuuuugagacggagucucgcucugucgcccaggcuggagugcaguggcgcaaucucgguucacugcaagcuccgccucccggguucacgccauucuccugccucagccucccgaguagcugggacuacaggcgcccgccaccacgcccggcuaauuuuuuguauuuuuaguagagacgggguuucaccguguuagccaggauggucucgaucuccugaccucgugauccgcccgccucggccucccaaagugcugggaaucuuagguuauuuuuaaaacuuuuccauuuaagcugaaacuuaagcagagaugucagagggcugcaugaaaccuaaagauaccaaaucaacacuccuauauucucuccucauuucggugucuauuuccacgccccccagucuuccauggacuuccaauuccauuuccccaaguauuccauucucuacgggacagcaauaaaucaaugagauaguuugugacaaauuaauuagcaggaaguggugcuaaugagaaaaacgaacaucugcaggccaaagucuaucgugaagaaccccuugcugcccuuuaccagacacuccaucucuccgccuuucacuuuagaaacacgauaacuggaauucuccaauuccuuuggggguaagaaacuucagagaucuuugugauagaaaaugaaguaggaagacgauggaggagcauugcuuugguaucuucagacuucaagcaucccccugguaucucugcuuacguucuaguuuaaauggaaaugugcuaaaaauaacuugaagauauacuguaaugccauuacauguuugaacaguaugacaaacuuaaaguaucguuauguaagacagaaaaguuuuaagaccauauugauauuuucacaauuuucacaagccuuuauauaguaaugcacauuuaacauucagaagggauucccucaaagggaaacgcaaucggguaaaagugccucuggaaguaggaacaugaacacaguacucggcagcuccucucagcaagguuagccuaccucccuaccuguggcuggaugaacgaacugugucacagcacgugggagaugacaguggaggaguucugagccuuggcccagcggauuugcugcuuuccucgagcacccagaaccccgagaccaccauguaaacggguccaggacaggcugcgggaugaucacagacacagggccuaggagcugcugccugcagcgaacacccagccaccuccugggagcagggcccucgagcucaacagcaacugaucaaacaugagucagcccguggaaaacagccaaggaaacacccagcugagcccagcccaaaucgcccacccacagaacggugacccaaaugaguggaggcuguucuaagcuaugagguuuugggaugguuuguuucccaacaaaaggcuaaaugccauucucuguaauuuccuucacaauacuuaauauuggcccaaagacaauaaaacguuucaguucagcucuggauuugccuacacuuauuccacuugaguuucucauguauuucaucuaaccuaacagccaucuccacauuccucacaagauucaaccucucccagacucaaccugccucucaucuaacccaaccaccaucuccccacucuucacaacacucaaccucucccaaacucaaccugccucucaucuacuaauccaaccaccaucuuccuauuucucacaaaacucaacaucucacaagcucgaccugccucucaucuaacccauccaccaucuuccuauuucucacaacacucaaccucucccagacucaaccugccucucaucuacuaauccaaccaccaucuuccuauuucuaacgaaacucaacaucucccaaacucaaccugccucucaccuaaccuaaccaccaucuccccauuucucauaacgcucaaccucucucaaaugcaacuugcuaugaacagauuucuacucaaauacacagugaacaacuuccacaacgguuuccuuuccuuccuuuaaucauccuaaagaguuacuuuuaaauagaauaaugaaguuaacugaacuagcuacugauaauuuucuauuuauaugaguggaagguuuagaaucagaguuccuaaguagcaagaagaguugacaaagaacaaaugaguuuuuaaaaaacuuuuacuuagauguaguuacuaaaauaagaaaacuacuuuuaguuuacauacauauuauuuuucuuaaaagagucugguaacuaacuaaauuuccccccauuauucaaccacccuuuaaaagaaaguguuugguuuuaaguaaauugcaccucuccacagaaguaaccaagacacuuaaaauacaaaacaggcuggguacagugguucacaccaguaaucccagcauuucaggaggcugaggaaggcagaucaccugaggucaggaguucaugaucagcuagccaacauggugaaaccccgucucuacaaaaaauacaaaaauuagccaggcaugauggcgggugccuguaaucccagcuacuugggaggcugaagcagaagaaucgcuugaacccaggaggcagagguugcagggagccaagaucgugccacugcacuccagccugggcaacagagcgagacuccaucucaaaacaaaaacaaaacaaaacaaaaauacaaaacagcuuuuucaaaggauaguugggugagcucaauuuaauccagaaaaccaacaguuucaaaaauaaucugugaaucucuagaaguaacuauuuucuuaaguuuuaagaaauucaucaauaaugauacuaacaaaaauagauccuacuaaucugaacguuuuuuagaguucaaguuuuugcugaauaaugugcaauggcaauggauacucaucuuuuauacuuaaaacaaaagaaauacuuuucaauccagaggaugauacaggcaauagcacuacucuacagcccaaggacacaacacguaacucagguauauucaccuggaaggccagccucagaaucuagauacucaaucucacaaaggaggcugcuccuagguaagcaaagcagaaacaaagaggaacccgcauugcuacuaaacugcuuuguuguucuuauucuuguaauuuuggaagguaugggagacagggugucucaaguggaagagcagccuuaacuauauuaaaaaggacaaauuuaaaagggcuuucucaacaauaguuauuuagauaagcguuucccuuuaguauuuuguuacaaucuauuuccauuuuaaauuuuacgcauucaaccaguauuggcuggaugccuagaugccagucaguuccuaaguaagugauacagacacggacagaguccaguuucagccuuauauucugguggaagucaaaugacaaaagcagauuuuuuaaacaugcuaaaauaauuuuuaauauguauuauauauaaaacacacacacacacacacacacacacacacacacacacacacauuuuugagacggaguuucacucuugucccccaggcugaagggcaguggcacaaucucgacucacugcaaccuccagcucccagauucaagcaauucuccugccucagccucuggagcagcugagacuacaggugugcgccacuaggcccagcuaauuuuguauuuuuaguagagacaggguuucaccauguuggccaggcugaucuugaacuccugaccucagaugauccgcccgccuucaccucccaaaguguugggauuacaggcgggagccacagcgcccggccauaggcccuagaacacuuauuuuaaaaauuacugaccuuaaacucuaaucuugauacuuuguagauaugaaacuucgugugacuucuuucugaaaucaacauucugccaauuaaaaccacauauggauauuacucauguucauacuuuccuaaucaguuuccaucuucuaaaugagcuugccacacuauuaagaaaaagcacuuccuuuuaaaauuuuuuagauccuuaaaaaauaacugauuuccauuuuguugccucaaccaacagacuaacuugguauuuacaugacaaacccgccuuuuuucacuuaaauauguaaacaccuucagcugggcaacaaaucgaaagaagaggaucaugggacaaacaugcacaggaucuaugaaaagaugaacacccccugagcaggcagcuacucgguaccagcccugugccaagcacugugauaagaggaacacggacgucugagacagaguaaugucaagcagcccuaagaauaaagaggcaaguaaaaaaauuaauagaaagcuaaaagcaaaccaggacccacaaaugcauuuuggagaaucuuuuaacuaagaacuuauggcagggcuauuuuccauagaggucaaagaacauacggcaaguccauuuaaauaaaaauucuggacugggcacaguggcucacgccuguaauuccaacacuuugggaagccaaggugggcagaucacuugagaucaggaguucgagaccagccuggccaacacagcaaaaacucgucucuaguaaaaacagaaaaauuagcugggugugguggugcacaccuguaaucccagcuacuugggaggcugaggcaggagaaucacuucaacuuggaggugcaggcugcagcaggcagagauugagccacugcaacucgacucuggccuuggcaacaaagcaagacucugucuuagaaaauaauuaauuaauuaauuaauuaauucugucugccaagggagcuaacuuuaucauuagaggccugaguuuccugacagauugccuuaauaaguaaaggaauacuagugguguggcauuaaggguuuuccauggugagcuggcaaaacuaaagaccaaagccuggccuagaaagcugcuuaacuuaaacgagguaucaaugacccuuggacaacacgaguuugaacugcacaggcccauuuacacaugaacucuuuucaacugaaggcaaaucaaaaacacaguacucacagcacgcgaaagcgcagcgucuguggagggccggcugcgggaccucagaacgcacagaugugggugugcgcggacgguccagaaaccgauccccaugcucuccgagggaugaugcacacuguucauuauaucuguuuuauuugugccguaugccucaauggggagacagaacaucugaugaaacagguguauaaagaacuacagguucuuauuucacuuggaaacagccuugaaugacgguuucuccuaaaucauuucaggcacauguacaaauauauagaaaagugaccuguccauuguuaagguuuaucuagcucauuuauaauuuuuauacagguuuuauuucucuauuacauuaagcaccauauaauguauguagaaauacuugcagguuguaaggcauuauaaaaaugcuugucacugucacugucaucacugccaucaucaucaucaccauuauccuuacccgcugguccuccuuuaugagaauuugugaggacugacaacccuggaaccuccagaacagaggaucucaaaaccaggauuccaagaagacggucagugcaugaacacagguucggcacuucacugagccccuugguauugaaucaaaucacugucucucugaagaaagaauauacagcuuuccacagauucucaaaguuucugugacgccaaaaccaucaagaaccacaguuuuggagccuacaaauaggcguccaggguggcagaaaagaagcuucgcucaaccuucacaacugcaauuacuguguguuacaaucuauuugcucacaaaacaaaugagggcuacuuacugcucuaucagccacugugcuuagaagaggguagacagaugauuacgcuggacuguguccuugaguucauggagacggacugaagucacagacaggccgcgcacugagucauacacuacaacagaggaacacacaggaagugcccccgcagcgaagagaagcaaaggcuaccuggcuugaaggaaagguuuccccggagaccccacgauggcuuaccaggccagccuaaccauuaugcauugagugccuguuauauacaccaagcauucaaagacuuacgugcgcccacaaagagcugacaaucuagaggaaaggcgcguguaaauaaacaauuacacuagagugauacugcagucauauguuuaaguacauaaaagauaagaaacagcuccacguaacgaagagggcugucaagaaagcuuuauuaaguagaguuaugagauaauacgagcugaccacuguaugcccaaaggcagggagacagaaaacggcgaggcacagagggguagagggcugcacagggcaggggcugagggaccagggcugcacaggagccagugagggaagcacgggugauguuaaaugggagagcagggaggccuguuagggcaaugcggcuccgccacggagagacuggaccccgugcgaugggagacagugaaacggguuaaggaggauuccgugacagaugaacaccucagcucaagaaucacgucuguauugucagaaugccuccuaacgcaucacaccauaaacuacaucaacuggcacgcgcuacuuuccuuuaaaaaaugcaacagaauauuucaaaauucaauggcacuaagucgacgugcaucauauuuccaucauuugucguguuuuuauaauuuggcacagacaugaacuccaugagcagaguauaacaccacguaauuuuacucacuaauugugacaaucuagugagacagucuauggaaagaccauaaaauagggccuguacacggcaaguacucacuaaacguuaacuauaauuacaugcugaugaugauuaagaagaaaaagcuuaccugugauaagaauaugguuaaauuaucacaaaccagaaagcagucuucagaaacuacauaaauagcugaguaacuuuuauuaaaaaaaaacaaaaaaccaauugauuuaaaacuaaaaagacuguauuaguagacucuccccaacaugaaaugaguaagacauucuaaagaaucccauucaacagguugagccacucggaggccuagcaauggaccgaguucaacaugguaucagauauucgaggagauaugguacuguugaacuggcaaggcaaguuaauugauaagacuggcccuugaaguauauaugugaauaguuuccuagacuuacugucacugcugugaaacuggagaacugccaauucaacaaguacaggcaugugcccuugaacggcaaucuuuccaaguccauuuauuccuaguaacaaagacagaaaagauugcgcuuuguggcacuaugucuuguauggagcaugcacuauuuauaagcagcauggucugcuguuugaaaaaaaaaaaaaaaugccagaaaggcaacugcaaaauaacaguacacaaaacacacacuaauaaauaaaaacgugacaaauccagcccuacgaacuaaaauaauccaaaaaguaaaaacaaugggaacuaaaugguaagaaaaucuccaacauuuaaacuaacaccuaaagcuuaaaaucuuuucaauuuucauaguuguacacgguagguaauacggaaagaacagaccagguauuaagugaacauuaaaccucuacacacacaggucacucaacaaauuacgaacacccaauccuuaaacauccuuaggacaaaaaacaguucccuggcaagggggacggugaguaagcuuacucuggcuuucuugccccguacuagauggccaagaggacagcugcugaugccaaggcaccaaggaggacaaggcaagagaacgauggccucauguaacucgaugcagagggagguacaaaucacguuagcuuuggcgugcaggccugaaagcugggaccuaaccaccaucuuaaacaugguuuccacaagaaaagccuuccaacaauuaacguccuguccaguucagaugggcagcauuuuuaccgauuaaaucacacuuuuacaacugcaaacacaaauaugacaccuguccaucucuucaauggccaaugagacaagggaagcuacaggcacucaccuggauucacccacgccuucgcuggccugaucuugacuugcugacugccaccgcgacggaauucaaacuccuguccuccuaauugugcuagauagcaauaugucauucagaguaaaaaugcuggaagauucuuacauucaagacuccuucaggaccaagcaucgaaucuaggauucaaggcugcaaccuggccuaacccagcuuagcacagaaacccacuucacuagucguuuuugaacaggcucccucgcagcauccguagaucauucuucaaagaguaagaggaguaaaaugcgguucuggcacuuagcacccaagaagucuugggcaaguuacuuaaccucucauugacguuucauccuguaauguagggauaacagaguccacccggugguugugagaauuaaauggacuggcacacacagaaugccgggcccagugcccggcugugacacucagugucgugguuauuacuagacuggugcucaccaccagugucauuaccacugacagcaugaggacaaagccggccugucugacguaagcuguuuccaccccacaccuccaggucccggccccugcacacucugagaauuacaucacagcacgguaagcgucacugcgugcugcuccacaacgugggacggcccugagucacggucccccgaguucccauccacagccuuuccaggcuagacuuguucagucaguaacgcaucaacgugguaaacaucauacaaauaacuaaagaaaagcugaaucucuguuguuuuuaguaagaaaauggaacuuccuuaggauuucgacuagauccuauuuucaccuuaacaucuuccugcuucaaagaaggacccuuccccugguagaaauuguuaccacgcccugcuugacucagaaucacacacacacaagauuuuuaucccagaacacagcaacaacacacugugguaacaucauuucugccaagacacaacuuccagucucccuguggcugggaaacgagcuucuuuucucuuaagcuuuccuaggaggagaacauaaagagccaagaggacagcagcugcugccacuucagggaggagccagcaacacaaaagcccuuucaccagcacauuuuuuaacucucugccgggccucccacccgucucuaaucaaguuccugcugccaggaauucuagccccagcucccacagggcaucaggucccaccacagcaggccaggcuuccagcagccacccagcucucagccacuugcagacccuuuagucaggauccggggcccgucagccuccuccacauuccuucuccugucacaggaggacgugcagcaggagcagggaucccaggauguaaguaaaauauccuacuuuauaugaggaaaaggguuucuaacuugaaugaauaauaaauagcugaaacauucagaguucugcagaaccagacagaagcuccagaaacauuuucccugacugaggucaacaaucagguuagccugggccggaauuccguuccguucccacuguagaaacgcacucaccugugugcaccuaagccgggcggccaggagccgaccccacacaggugacacagggaugaggccaggagccgacccccacacaggugacacagacaugaggccaggagccgacccccacacaggugacacagggaugaggccaggagccgaccuccacacaggugacacagacaugaggccaggagccggccuccacacaggugacacagggauggugcuccaacacucuccaucgugugaaugcagccauuuucucuuaagaaaaauguccucauuucccuuccuguauuucaugaaugcugacuuaaguugugacaacggcuguacuuccauauuaauucauucccagucuuuucaucaaaacguaaauuucaauccugaaaccaggauugggaugcuaaaaguaacacagcaguaauauguuuagagaucugcucuuaucuuaaugaaaaacacgggcuccccaaauaaguagagucagaaggggaaacacucguccugggcugcuuuguauacuaacauuaacagccaaaaagagaaccaaacuacucuagacugaaggucaaacacauuccagggcguccuguacgcaauacacacaucagggaacagaccucaacccaacacugcuucaacaccaacuucuauucacaauuucuacaaaaucuucuggccaggcauuuuucuagacauucccuuaguuuuaaaaaugaacaaaaagcugcagcauuucauuggugcucaaguaauaauuaacuugcuaaguacacaucagcuaagaacacuacaccaaauuuauuccacacacccacaagagggaugcuccagauuuuauucugcuuaaauuacaggaaaaccuguugaagcuuacaacaaagcaacagagaauggaucugaaguagaagaggggguuggaugcugagacgcauggcaggcagaccgaacccugaaugugggauuacacaugcuucaaagaucuuuacuccgcuaaacaucuuuguuaaaucuacuuuauaauccucacuguagaccuuacagauagcaaucugaggaggagaaucuuaauuagagcucuggaaacuggcucucuaacgagaccgacuuuccaaauaauuguucacauggcccucuccccuuccagaccucacauggaagggcagucacguggcauggaucugucagaacaguucaccaacauccagaggccucuccaggaagggcagaugauaccgugagaccugcagaguccacgcccgccauccccacucugccacuacgcuuucucucgcugcaaagccauuugcagaacauguacaaaccacggagcuaagaacacagagcuaacaggacuguccguuuggugacagauuuuuagguaguccauagaauuucuacuucuacaaaaacagaaaacuacguuucagaggauguuuccaauuuaagcagauuuaaagagaagaaaaggaaagaucuuaaaauagaacuucauucagcuugcuggauagguucucuguucugugaaaaguauauaaaugauacacauauuugacuagguugaaauagguaaaauaugacaaaaauuugguuauaauacucaaccaacacuaguagcuuuaagucaaagacaagaagcaaacaguuacguggacagguuguugguccccagagccacagcacuccugcacaggcucauauuaauuagcgcaauauuaaaugcccccgaguuaggcaaagaagacccugguggacaugggcaaugggcaaggagcgaaguuccagcaagcaccagccuggccugggccgggugcacgccaaggcacaccaagcuguagugcagucucuggcagcccccacggguguuccucaacugccccuccaucucuucaccugacacgcaucuuuccacacuuccuucaugcccuagaaauuaguuaagacacacuccaagugaauaauuagcaugccuaauuuuagccaacaaaauauacugauuuuuccuaaaggaguuucuacacugugauaccaauuguccugccaggaaucucugaagaaauaacuugggcugauaauucuucugccaaaaaauguaucuuguaaugaauacgagguccaauguguaaauauuauucuaucacuuuuguucauuuccaaaagcauauaaacguaagucuacuguacacuacuuacuuucucuguaaagcaaggaccacagaauaaaugaccuacaaauuuccagcuucucucucaccuuuaaaucucaauauuuacacacaguuucuuauauacuuaccaaccacacugcccacaaucccaacaccuccccgccucccacuaaauuacuacuggaaaagucuggcacugcccuuucuggaaaauaccauaaaucuauuuugggacaccaccucguuuggcugguuguuuccuuauuuuuuuuuucuugguaguaaaaauaucccaaucucuuaaauguguaggugaaaaauacuaguuucgaaaugauuccuuaaaaagcaacaauaaaaauacucuucuucacuugaaagaaaaaacccaaaaggcaguguucauacaaagucaugaagagaauuuaaauuaagguuuugguuccauuuugucucaacuuuaacuuuuaacaguucuuuauaggcuuuugaaaccuacuuuggagaaggaaaaaaaguaggaauaacuguucuucaaaaauuuuacaaaaacaguuugacucagcuucaguuguuaaauuugggguauuuuucuauguugaaacaguauuugaaaauucuaacuuauacuggacagauaaaaugauaaaaaagacauucuacucuucagaggauuaucaaaugcuguugauuaugcuaguuucucuugaaauaaacuaauuauggguauuuuagauagugauauauagucuguagacuuaauacauaggccauaugcuaguggcacauaaccaacagagaaagaauuccuugcauuaauagaagcacaaaaaauauauuacaacuuccaaaauaacuuuuuuuuuuuuuuuuuuuuugagauagucuggcucuguugcccaggcuggagugcaacggcacaaucacagcucacuccagccucgaccuccuggacucaagccauccucccaccucagccucccaaguagcugggacuacagguguaccaccaccccagcauuuuuuuuuuuuuuuuuuugguaggaacgagguuuugcuguuacccaggcuggucuugaacuccuggccucaagcaauccucccaccugcgccucccaaagugcugcgauuacaggcgugagccaucgcacccagcccaaaauaauguuuuucuaaacagcaguuacauuuuucaugugcuacacaccuaucagauggcauggaucccaggguggguguugacugaagacucucuuguuuuuuugugugugugguauuacugaauauauaaaguuuaaagguaauuuuaaaaaggucccuuuuaaaaugcacagauuuauaaaguacacaugggugagauuaguaaacaaauugagccccaccuauugcugaugagugcuaugaucaccccuuuucuauuuccacuaucauucucagagggcaggacaugaaaagccaacacauucgcucauuuacuccugcagucuuuuaacacugauugaccagcuucuaugugccaggcacuuuuugcuaggugcuaaacacagaagaugcaggggcuaaaagccugccccgaaaggcucacacuccaccaggacauauugacauauaacuacaauaucugcgcagcaagacugagguauguacaaagugcaacacacgcacuuucuagcuuggacugcugccuuggaggucccgguuucagaaccuucaguauuacaacaaagcacugcuaccaugaauaaaccuaccacacgucaggaguuuucccguguuauuucacuuuacucucacuuaaaccuuccgguauuucuaaguguccccauguagaagaggaaaaaguuaguucuaagaagucauuugcuuguccaggaucaccaauuaccaacuagaagagccaggauuccaagccaggucuucucaguucagcaugccacuaccccgccucugccucucgaccaaaaccuagacgagguacuaagugaagaccacauuagagaaguuuuggcacaucaucucugcacuggguaacuuugccggugugcaacaaccucugaauggcacgccagaugguagcaguaguuguucuaaguaugagccugcaaauacacugacugaaaaaaguuggaaagacuucucaaagucagaacaaaaccauaaugaugcuuuugauaauagaguucaaaauagaguuuggagaucaguaucagugauaacaauuucaauguaucccuggucuuuuacucacuuuacgccacuuaaaucacucaggcccuuuuguuuccaucuucauggcuuacuacgaauaaacacaucuacaauacagcagccgggccaaaaaaaauauucacacgcacuucuauaccgagcccaaagagcaacagggaauuuugaagaagcugccacagggcagaugguuaaaaaaaaaaaaaaaauggaaaagggcaucaaaugagagcaauaaaaacauauuuaccugucucuucaccuauuuugaaaacaccaacgccagagccaucucuaauggaguaucggaucuccccaucucuucuggcguccucaucaugagccgacaccgucauuaccaaugaaccaacaggugcaucuucuuucacuguccccuuuuccacaaagcuggaaaacacgggugggugcagguucucauucacaucaaccaccucaacuucaacauagcaaguagaagacagagaaacuggcuuucccuugucuuuggcccucacagugagauuauacacuugcuucuucucaaaguccaacugcuggacgauccuaacugcuccacugaguuuauccacaucgaaguuuccuucuccgugguccagaaggcuguaucucaccugaccagacugaccuaaaucaggaucgugggcuucuaaccacaugaugacgguuccuucuggaagauccucucggacuuucacacgauaauuagguggaauaaauguagguggguugucauuaacaucuucuagugauacuuucacaacgacaguggagaacagcugaggcucuucucuggcuuggucccuggccucaaucuuuaaggagugcucaugcugcagcucucgauccagagggcgugcgauguuaacaacacccgucacgcugucaauugaaaaugugucugugucuguaacaauugaguacgucacguguccguugggccccaggucuuuaucuguggcuucaaccuggaugauuucacuauguaccuccuugucuucacucacuuccacaaaauagcucuccuguaaaaacucggguggauuaucauuggcaucgacaaccacgacauguagaagacgccacgcagccuucugggguaucccaaggucauagacgguaauauucaggguguauuugucuguuguuucacggucaagaggagauaaaauuuucagcauuccuguuuccauaucaaucaugaagcaacuauccucauuuccuccagaaacagcauagaccaguuuuccauugaagccagugucaaggucaguggaguucaugaaaauuacacuggaacccacaggcugguuuuccuuuaccugaauaccagucggaagagugcuucuaaacugcgguaugugagcauugacagagugagaaucgaagaaaauauccuccaccucucccugguuguguaauuuauuugccugcaggagcuucucugccagcauuuuggcaacaccagucucuucacacugcaaguuuaccagcuugugacuggcagccacuguuauguugauauauaaugguguggcaaaauuuucuccaucuguagcugugauucucagacuguggaaagacaccuuugcaccuaagccauccauuagcgaucgcuuuaaugacaauacccccgaguugggguuuaaacuaaagaaauccaguucauuuccagcuucaaucugauacuguaccaacugaaguucaucugcaucaauagcagaaacagugguuauuugcucucccacgccuagaucucugggaauugucccuucacaauuuauuuucucaaacaaagguguguugucauucaaguuauugagaguaauuguagcaaggacuucgacuucccggcgguacggcaagccccagucugaugcacgaauccucagaguauaaacccgaggcaucaguucguaguccagguuuucugacguacucacggcaccagugaaauggucaaucgcaaacggcacaugauuuaaauuugcgauacuguaugucacguacccguucucacccucaucagggucuacggcacucaggcucaugacaguaguaccaaugggcacguucucaucaaaagcagcuuuguacgcugucuggguaaauucagggggauugcuauuugcaccuaagacuuucaccaagaccuugguggacgcuuuucugucacuuguuguuacuucaaguucaaaaugggcugccugcugucuuuuaacugguucuaaaauagaaaugagaccaguguuguaauuuaaacugaauuuagcuuuuccagguguacuuuuaaaaacauaccucaaaugggaauaagcaggaauggccuuuaccaugaccacagguguguugggaggagcaaauucacuuauuucugcucuguaaacauccuuuucaaacuugacuggcccggcuuugaacuguggagaagucacgugaaugacuuuaacagaagagaacuggggcggaguuccuuuaucuuuagccuguagugugagauuguagccgaaaggaugacugucccaaucaaugccaccgauggcuuugacuuuauacuccuuacucccuggaaaggaccucacuguucuaaacugcuggagaaggucaccugccacgaugcuuaaagaugcuaugucaccauuggcacccugaucgcagucauccacugucacaauugcauaugcugggucccuguccaguucugauggugacaaugucacugcuguuaucaccggagcacauucauuggccuguucgaugugcaccguuagcuuggccaugcugcugaugccacugcucccauacaacuucaugccacgguccgcagcgaggauuuccaucucauagagcuuggucucuagguaaucaagucuaccaguuaacacuaucacaccacugguugggugaauagcaaacauaucuguucgaucuuuaaaacuguaguaaaauuccccguugguuccuaugucugcauccguggcgcugacucuugcgauacugguccuuauagcuguguuuucagguaaagaaacgcuguaugaggugggugagaauaacggucucaagucauuuguauccagcaccugcacccugaccuuuguucgcgccuccacauuaguauuuuuuucaagugcuuucacuaucaauguguagugauccuucacuucucuauuaagaauagcuguauuuccuccuuugguccuuauucuuagaaagcaaaagucuccgagaauguacucuucagcuuugaacagguuuucacugucuccggaaacaauuuuguaccuuacuucccacgcuggauguguaauguaaacacccaucuugacaggaugccccacauaagucuuagcugcagaguucuccugcacggugacguuguacucgagguguguaaacugcagaggagucuguucaagucguuggcugccaucacugucuccaaaauguuggaagagaaggagcagaagcaggagcaaagccaaaugucuccccauugcuuaa

SEQ ID NO: 21447 - RNA, 4392 nt, Homo sapiens
uguuuggucuuuaggccugcggaggggcguuaucuggagggccgcgggugcaggccgcagugacagggccgcucgccccgcuaguccugccugucucccggugcagcuguguucgcggccugcaggcccaacauggcgcaggaggugucggaguaccugagccagaacccgcggguggcagccuggguggaggcgcugcgcugcgacggcgagacugacaaacacuggcgccaccgccgggauuuuuugcuucgcaacgccggggaccuggcccccgcuggcggcgcugccuccgcuagcacggaugaagcugccgacgccgagagcgggacccgaaaccggcagcugcagcagcucaucuccuuuuccauggccugggcgaaccacgucuuccucgggugccggugagugaggcagcgucccuaaccagcacgccucguuuugugugccaccugcagaccggggcccggcgcccuccgcgggaccggccucggcggggaggggaaguugugaagcgcgggaauccgccggcccggcugcccucuaagggggagaagggcgucccugcgaggagccgacaugauucccggacgucugugugcccgguggugugggcgcagcugcugguaggguugcuuguguuagggaacaacgcucuuggggacgggugcgagauuuaagauuagugaggaggugcccugccucccagacccuggggcacuuguuuaugggguuccaggaaacaguucuuggcgguugguucacuuucuugauugcagccaggaaaugcagucccuguggccuguuuuuugcacaaguaggaccuuagaaaaaacacuuuuuaaaaaugacuuuuccuucuuuuucagauacccucaaaaaguuauggauaaaauacuuaguauggcugaaggcaucaaagugacagaugcuccaaccuauacaacaagagaugaacugguugccaaggugaagaaaagagggauaucgaguagcaaugguuagcagaucauagaugugaacauacauaggaguuuagagcauaaguuugauauaauuaggaauuauuguuacuaauuuuuuuaacaagccagaauuuuuauguuauuaauaaguaauaaaguuggaauguuaaaccuaaaguauauaucugugucuuuaggcuuugaauuugauaguuugcuuugacugcuuuagauuuugaaguguccacuguugucugaugcuguuauuuuuuuaauauuagacauucaugauguuauucaacacuguuuuaagaaauuaaugacuccacacuuuuuaaagaaacgauuagucuugaaauguuuucacuuugugccuuuauuuuaauguguauuugucucaucacccguuuuguacgagguauucuuagucacauaucuauguuuuucuucuuuuuagaagggguagaagagccauccaaaaaacgaguuauagaaggaaaaaacaguucugcaguugagcaagaucacgcaaaaaccucugccaagacagaacgugcaucagcucagcaggaaaacaguucaacguguauagggucggccaucaaaucagagagugggaacucagcucggagcucuggcaucuccagucagaauagcucuacaagugauggagaucgaucuguuuccagccaaagcagcagcagcguuuccucucagguaacaacggcaggaucugggaaagcuucugaagcagaagcuccagauaaacacgguucugcaucauuuguuuccuugcugaaauccagugugaauagucacaugacccaauccacugauucuagacaacaaaguggaucaccuaaaaagagugcuuuggaaggcucuucagccucagcuucucaaagcagcucagagaucgaggugcccuuguugggcuccucaggaagcucagagguagaauugccacuauugucuuccaaaccuaguucagagacagcuucaaguggguuaacuuccaaaacuaguucagaggcaaguguuucaucaucaguugcuaaaaacaguuccucaucaggcacauccuuacugacucccaagagcagcucuucaacaaauacaucgcugcuaacuuccaagagcacuucccagguagcugcaucacuacuagcuuccaagagcagcucccagaccaguggaucucugguuuccaaaagcacuuccuuagcaagugugucccaguuggcuucuaagaguaguucucagacuagcaccucacaguugccuucuaaaaguacuucacagucaagugagaguucugucaaauucucuugcaaguuaaccaaugaagaugugaaacagaagcaaccuuuuuucaauagacuauauaaaacgguggcauggaaguugguagcuguugguggcuuuagucccaaugugaaucauggagagcuccuaaaugcagcuauugaggcucugaaagcaacacuggauguauuuuuugucccacuaaaagaauuggcagaucugccucaaaauaagagcucucaagaaaguauuguuugugaauugaggugcaagucuguguauuugggcacuggcuguggaaaaagcaaagaaaaugcaaaagcaguugcaucaagagaagcauugaaguuauuucucaagaaaaagguggugguaaaaauauguaaaaggaaauacagaggcagugaaauagaagaucuaguacuccuugaugaagaaucgaggccuguaaacuuaccuccagcacuaaaacauccucaagaauuacuauaauguguccaaaauaucacugcauacaauaucugguauuugaagagaaaaacugacuuuuguauaguauaaaacacaggcuuucacaaauuuuguauugcuuuuuuuccaguuuugcagaaaauuuacauucuaguucucuucacacaguagcaguuguaaauaauuuaugaaugacaguacacauuaaaagguaugcauuagcagcauauuaguaugcuguuuuauuugcugaagaaaauacugucuucuauuuuuaaugauacauuagguacgauguguaguucgguagaguccuaaaauuuuuguacuacuuucaauuuggugaaaauguauuaaguugucuaccauguuuucuuuucuagcugaauaaaccacaucaaaggaaagggaccacaguauuugaauguuugaaagucuguaaagcuuaagguuuuaaaaauguugcccguaauguugaacgugucuguuaaaaaauaaaagaaaaaauaguugcuucaaacuauuuuuaugagaaguuguaagcauuuuuuagauauaaagcaguauaaaguacuuguuauuuuacucugaaguuguuuaaaauucaccaugacuuugaccgcugaagauucuuuaagcggguuaauuuauguuuugagguggaauacaauuuacacuuuuuucuuaaaaacaugaauguggguuucuauauuaagcauauuuugugacuacuauuaacagauugauuuguuuagauauuaaaugcuuuaagcuauuuuaccuuuucaagaaguuguguuuuuuuucuccaagucagaaccaauuccugcaaauaggcuucccaugacuugucauuauaaauuagacaaccagguaauugugugauauacaucuuuauuuaauuuuuuuuuuuacagcaauccccugagccagaauagauuaaaagcgauucccuucaauuuucaaaucuagaacuggaugguuuuuguguuuaugcaucuuuuagaauaccggaaagaacagagagccguguucagcucuugauaaugagccuauucaauuuaacuacauucguuaaaaugaaguggaauuuuguuuucgucuuaggugauucugccuguuugucugucauuguauauucuguuuacuuugcuucaaacuggccccaagauguuauuuuugugguuucuggcuuucuagauucuauuuuuagauacugcccauugagcaauaauggugauaauauagagagaaaagaaagaccuuucaugggccaguuguguuggaauaggaaaaucaaacguaagcacaauuuaaguauguagcaguuauuccuauuuuguauucuaggaauaaaaagauacuuuaauuuuuuaugcuagaauuacauaauuacauaaucagauguuuuaauuuuaccauauaaccuuuaaaaaugauucauuuuugaggauauuuaauuggauaccaaagcuaaaauccauauacuguaaguggguugccuuuauagauugcgggacacaauaacaugaauguauugugaaagcacuuuuaguuaccucacuuuccucagucuuggaauguguauuuugugggauaaugauuaucagaaaagcaaaaaauuacaacgaacaaauaaauuuauauaaua

SEQ ID NO: 21448 - RNA, 4109 nt, Homo sapiens
aauauauauauauucauguuuauuuaagaaauggaaaaaaaaaucaaaaaucuuaaaaaaacaagcaaacaguccagcuuccuguccuccuaaaguggccccuguucccaucucccgggccagacagcuguccccccguccuccuccccagcccagccugcucagagaagcuggcaggacugggaggcgacagaugggccccucuuggccucugucccagcucucugcagccagacggaaaggcggcugcuugccucuccauccuccgaaaaaccccugaggacccccccccauccucuucuaggaugaggggaagcuggagccccaacuuugauccuccauuggaguggcccaaaucuuuccaucuagggcaaguccugaaaggcccaaggcccccuccccagucuggccuuggccuccagccuggagaagggcuaacaucagcucauugucaaggccacccccaccccagaacagaaccgugucucugauaaagguuuugaagugaauaaaguuuuaaaaacuagcccuauggucugugccugcuggggcuccccgcgcccaccugucugggucuuggggggcuggcugggcacaggcaggcauggugacgggugccuggaagggggagaggagucugugagucccugcagauugaggcuuccggugucuccucccccagugugucauuuccaggcaguggaccccagcccaacguuacaaggacugcuucuccccggcccccaccaucaucaccacagucuguuuuggcuauacuuccccccccaccagccuuguaauuggcuaauuacuggagaugaauguugguaaacagaagccuucuucucuucugccaucugcuucuccauuauuugcccauuguacaccccccuuuuccucccacugaagccccaguuagucagcagggccuagagucccuguccccuuuugaguacagccaagugggggauuccccagcucuuaaguauugggggaggaaccaggggacccagagaggcacaccuugagaggacgcagaucucuucagggguacugccagguagcaggcuuuauugggaagggacaaagccucaggagcugggugccccagaggcugcugggucuugagccacagcugcagccaaugcagcagcucgcgccuccuucuuccguuucuguuuuuccuccuugaggcgcuugcgcuccuucuucucuagguccuggagcagcuccuggaagcgggcacuccuuggguccaccugguagcccaggagcuccugggccucagccugcagucgggcccuccucuccuugucagccugggccuucucccaguucucccgcugcugcugcugccaguucacaaucaucuguggcaucuuggccaugcacucugcgaugugcugcucccugcaggggagggagagugggcugugacacuggcacucagccagggcagagcccacccacccauaucucacccauaggccuuugcccacgagccugccuccucaacucccccaguagauuaacugucaggaaaagcccuugacaagugaagaaacaggaagagaugaugagaaaguuaccugugcaugaauuugaucacaagggcaugucaagccccaguaaaccccaggugccaaagccaaaucagcauuucacugagcugccuacugagcaagccaagugccacucccauggauaauuucacaccuuuauuucauagacauugcugagcacuuccuguacagaggccaggcccaauucuaggcacaggagugaaagcaagaaagacauuucccaccaauccuugaguuuguagcuaccagucacagccccauuuuuuucuuuuaaguucagggguacaagugcagguuuguuacguagguaaacuugugucaugggguuuuuuuguacagauuuauuucaucacucagguauuaaaccuaguaccuagaggucauuuuuccugauccucucccuccacccuccaaaaagcccuaguguguguugcuccccuguguguccauguguucucaucauuuagcucccacuuacaagugagaacacguuguauuugguuuucuguuccuguguuaguuugcuagggaugauagccuccagcucccgucgugucccugcaaaggacaugaucucguucuuuuuuaugacagccucauuuaaggauuagaaaaguaaaagaauuaagcccuauaauggucaucuggcugaggaggggcagaaacaggagucccugcuccaugauucccugccugggugaucagacgcaugacuucacuucaccaagccucaguuuccucaucucuaaaauuagggcaaucccuucuuccucuuaaggcuauuaggaaaacaagaagauuaaacaccaggaacacacuugaccuacccccuucacgcuccaggauguggcauuaucuauaagagaugccccuggucuggcccgacgcgguggcucacgccuguaauccuagcacuuugggaggccgaggcagauggaucaccugaggucaggaguuugagaccagccuggccaauauggcgaaaccccaucucuacuaaaaauacaaaaaaugagccgggugugguggugggcgcuuguaaucccagcuacucgggaggcugaagcaggagaaucucuugauccugggaggcagagguugcagugagcugagauugcacuccagccugggcaacaagagcaaaacucugccucaaaacaacaacaacaacaacaacaaaaagaugccccugguccuucagaccugccucuguaucugaccucugcccucuugguuccaggacccaucaccuuccugcccucaccuuuuccccagccacacuggcuuccuggcuguucuuuaaggcauaucguaucucagggcauuugccccagcuguucccuuuaccagaaacuuucuacccaagagaucgccccauagcuaagucugguuauucaggucuuugcuuaaacaucaccuccucagagaggccugaggcuucccaaaccaaagcugcccucaggcacacacucuucacucuuuuaccuuccuacuagucggcugucaccauugguauuaucuugccugucagcugucgccaucugauauuaagggcccuuuuggggccugccucggccucccaaauaacugggauuacaggcacgagccaccgcccccggccugggacagggucuugcacacgguaugcgcucaguaaagacuugguggugauggccggacgugauggcucacaccuguaaucccggcacuuugggaggcugaggcagguggaucacuugaaguaaggaguuugagaccagccuggccaacaugguggaaccccgucucuacuaaaacuacaaaaauuugccgggcgugguggugcacgccuguaaucccagcuacaccggaggcuaaggcgggagaaucgcuugaaccggggaggcggagguugcagugagccaagaucuugcgacugcacuccagccugggcaacagagcgagacucuugucuccaaaaaacaaacaaacaaacaaacaaaacuugcugaugaaugacuaaauggacguuauucugaguuuguuuugcggccaggugagcguauacauaaaucuacaacaugcagaugcugcgacgugaccccgaagggguaggcacgguuuggggcccaguucgcccacggggcacagagggcagccccgcgucugccugcacgcacgcaccucucccgacgcuucugcucuucggccagcugcuucacccgcagcgacuccugcauggucgccaggcucggguaccauucgcguucuucggccuccagcucccgcagcugcuccggcgacggccauaacgaaccggggaccaccccggaggcggcgccguaacgcgcgaacugcuuagccgcguagcgcggucccagcugccaccgcggggucaggagguccucggggucuggccaccggggucccggccugcggcgcgggggcggccgcgcccgguagccacgggaacccggggccagggucgccgccacaccuaguaggcugcgugccugucgcacggacgccgccaucuuggcugugcgg

SEQ ID NO: 21449 - RNA, 152043 nt, Homo sapiens
ccuccuagauauuuuuuaaauaccagaaauggguauguagcauucccaaagagcgggcuguagcuuuucauggacugauucagcaagcaccaaaaguuacgagguugauaacaugugaagggcauccauauuuaucuuuucuaugaguuguuuccuugcaugaauuucaauuacauggagaucuuaaacaguccauguugcccuauuuucauaauauuccuuggaauacuuuucaaguugucaauuuuagucucagagacucucuauaagcagaauauaguuuacacaaaauaauaaagacacacgcacaccaaauaaacauaacaugaagcuugccaguccagcagcaagcacaauugcgagcaccauuuggcuucucauagaacuccuggcuuggguguucacaggguuagucgaacugugaacuccacgcaacaguuaggcaagguauuccauccagauuugaaaguucugagucucagucuuugaccugaagucauaaaggaccuuuuuaaaacagaugucuuugcccuugaacccuuugaaguucaaaagggggucucuccccaaaucgacguaucucagugugauucaccacuucuugcauauaacagugcaaaucaaagauuuuuuuuaaagucagauuugucaucgcuucccauuuucaagugcuucagaguaccacgugcuucagggaauugagcuagaagccuacuggcaaccugucuguuccucagagcaggcuccuucaucacagcggcagcucacagaugguucucggugcucagcuccuggucucaaaggcagcuggucucucuagagguugaaagguaagccccuggcccuaaggugcuggggaggacaccaagaucagaucuuccuugugcaugacuugcagcauuguuuuccguaaaacuugugguugcagacaccaugcugaggaacuaggugacaccaguugaagaaaucuacgcaggauggauccucuaaaauaagaaaauauauuuagcauguuggcuagggugucuauccuuuuucuuuuuuuuuuuuuuugagauggagucucacucuguuaccuaggcuggagugcagugguguggugugaucuccgcucacugcaaucucugcugcccagguucaaacgauucuccugccuaagcuucccaaguagcagggacuauaggcaagugccaccaagcccagcuaauuuuuguauuuuuaguagagacgggguuuuccaccaugcuggccaggcuggucucaaauuccugagcucaagugaucugccugcuucggccucccaaaguacugggauuacaggugugauccaccgggcccagccuuuggugauuugcauauuaugauuuauuaauauuaacauagcaccuuuuucuuaaggugagggccuacagaacaaaggucuugggcccaccucccuugugccucuaugugguuuuucccauuaaacauugggacuuugguaggggggugagguaggggcaggauuuagaugccaagaaaagacucugaccauuagcaaaauuaaaugauuuguuuuuaaaaaaugucacaucuaauccaagaucaaugucugauccucccuauguagccugggagcuaccauggaauucaguguccagggaaauacccuaaaauggugcuuuagggauccccuaaggauauuguuguaccacuaguaccgcugguucugauugagaagggcugucagaggggagcauuaagggagggugugcugcugguccacgaacuauaauuucaggagcaagaagccugauguauugggagucaagccaccuuauuugccugcaaauggguugagauuaacugaaaaagccgggucuccaacagucuguguagguuuaagucaaucucaaccaguuugcaaguaaauaaauuuaagucaacaccaguccuuucuaauuucuuuaguuguucaaugagcaggacagaugugauuauuucacuguacaucaagaauucuuacucagaugggccucaggagauaggaaaugcaagugaauggguauguaaacauaagugcauguuguaggagcaagggcccagucauuucacuguuuuguuugagauggaauuuugcucuuguugcccaggcuggagugcaaugguauaaucucggcucacugcauccuccgccucauguauucaaaugguucuccugcguaagccuccuggguagcugggauuacaggcacccaccaccacgcccaguuaauuuuuguauuuuuaguagagaugggguuucaccauguuggucacgcuggucucgaacuccugaccucgggugauccgucugccucagccucccaaagugcuggaauuacaggugugaggcacacccccggccauuuuacuguauuuuuaaggcacaguuuugacuuuaaaaauauuuagaguauacacuacacauaauucagaaaugcuuagaguuccuucuucaagccuugauuuuucugccuaaaauuccuuuuuauacauccccuucauguaaguaagucaggcaggagaagugagauguauuacuauucugucaguauaagugcuuuuuuugauuauaauuacuaacagcugguuguuugagcuucuacugugagucagguauuucauuuacacuauugaagaugaccuuggaaucauuucuuugcuucacguucuccaugcaaucagcagauacucuuggcucaaucuuuaaaaugcacccagcauccaaccucuucaguacugccacugcucuaguggaaccuccuccaaccgcuuccuggcagaguugacaaguccuuguucuacucgagacaaccugcacuccuuucaccuuaacugccaguaaucuuccuaaagcuagauccuauugcucuucucuucugcucaaaguucuccauuggcuuccaucguacucagcguuaaaucugaaauccuuacacugacugacaaggccuccagucccacuuuucauguauugcuuaaccacucuucaccuuguuucuuguacuccaagcaucgugccauuccucaauuagauuaguauauuccugccucggggacuuuggggucucucugccaggaacacucuccuagagccauaugugguucaccuuccuugaggucucuguuuaagugcuaaauaaucaaguggucgugccugaucauuauaaucugaagguguuuuccuauuuccucaccccuucaccccugcuacuuuacuuucugacacugugugcuaauugguugauuuguuguccguuuccauuuugaagcaagcuugucagaaggugggagccgugccuguuuauuuuguaaucagaccccagaacaguuucugguucacaguaagcacuaaagacaugugugaaaaauggaauuaccuucuuuaauacucaaaacagucuuucgaaguaagcauuauuucccaguuuuaugaaugcucagaaaguucaaaacuugcucaaagcuccauagcuagcuccauagcuacugagugucaagucaguguggauucaacucuauuuuuaugauuuuaggguccuugcuccuuccacuguacaaugcugccugcccccaucugaagaugugggauuccaugaggagcagcuuauuaguauugagugccugcucauccuuaacuuaauaugacuagucugcagcccagguagcuuccagacacguaaacacccaguuucaaugcagugugacacaagucucugggugguaugacugcuuuagggccuucucucuuuucugaagagaauuuuauguauaauauguacagugcaaccauaaggauggcuuccccaagguggagauccaaccaagauacccagauaaggcaucacacacugaugaugauauacaaugacugccccuagacuggcacucaguaugggcagggaucugggggacaacaaagcuguuuggugacacuggaugacaggaggaugcagccaugggcagaauggucuucucuagggucuaguuuaagugacuacaauggguagaaacuucuacccaaguggaagcuccauaaggggaggaaacucucacagugccuagcagaguaccguaccugguccacaguggggggcucagagaagaggcaaagaacggaaucuucuuccgucaccaugcgccuccuuacugcucacuaauguuuucugaaaacucacagccagaaaauacacucaaacgacauucauaguagucacccugccaagcauguaaucaucccuauacuugggaugggaaugggagaaaauccucaacuuaguaaacuguaggccacauuuuugggucagaacaaacacgugggcucguauccuuuauucuuccaaaagccaccugacucagccaugaggcacagagagaaacuccucuuuuugagacagggucucaaaaaaagcccaggcuggagugcaguggugcaaucucgggucacugcaaccuucaccuccuggguucaagagauccucccaccuccccaguagcuaggccuacgggcaccugccaccacacccagcuaguuuuuauauucuuaguagagacgggguuucaccauauuagccaggcuggucucaaacuccggaccucaggugauccacccgccucagccucccaaaguguugggauuacaggugugagccacagcacucagccaagcuccucuuuuaauaagccauuucucauaugcacccuaugacuccccucauuccagcaccacagguagaacugaccaucacuguaacacugugaauauuccaccacuuauuuguuguuguagcuuucuuuuaagaacaggaccuuuuaagaauaggacccagcuguauucuuucaucccuagaagagugcuggagguauauaaggugcuuggugacuuggcuuugaacaagaucgaggaccucacagcacuuuucacaugaucuuucauguagcccuacacucaugcauuuauucauuuaagacuuauugaguaccuguugcgugcccauugugguauuaggugcugggugagccaaaaauaacaagacaaauggccuccuuggaccauacgugcauguugacuuuccccauccuuccaggagauacuguugggcaauuucauaauuggucauugucguugggggugcugguggccuucuaggcugaaucuuucuuugguaauuaaggguggaaaugagaaaucacugauagucuggaagaacaugaccgcuugcucauuucuucccuauguaguaucccagcauggacuaggaugaucuggcucugaguaacugcuacagagcuauuuuuuuuuuggucuugugcaagauucuuuagcacgaggcaagcagauuaggcugaaagauauuuccuggcauuugucagauuacuucaaauagugaagaaugguacaguuuacucagacuuuccauuuuccuaucaguacucacugcacuucccuugaacuaacuuuaagaaaacauuuagguauaguccuagggcaauacauauucacugaugacuauuacuuuugauuucugaauuuuuuauaucuucaacaaacaugaacaucuuuauauauggauuauaguugucuccuccauuaaaauaugagcuccuugagggcuauuguuguucaccuuuauguucccauuuucaaauuaauaaugguuaaaaagcauuauuguagcaauuaaauauucccuucagacccaugcaaacaagaucacuaggauaggcugggcauguggcuugugacaguaaacccagaacuugaggccaggaguucgagaucagccuggccaacauggugaaacccugucucuacuaaaaauucaaaaauuagccaggcgugguggugcacaccuauaaucccagcuacucaggaggcugaggcaggagaauggcaugaacccgggaggcagagguuacagugagcuguguacucccaccugcaugacagacugagacugucugaaaaagauuauuuggacagcaacuuccccagaguggugccuuauacaacuccagggagcacugucacauagacuucgggugaauggcuuacccuagaguuguacaaugucacaggcugcacuacuaacaaaguagccuuugaaaaaauuaucuaaagacuaguaaaguugacuggagcauggugccuuuuuaccucucuuuucaggagcuggacagaaguuuguauuacaggcucguagcaccggagguuucugauggagcagacaacuugaggaaggccggccuugcugaacacaguggacugaccgggucuggaccccucccccacaggugacugugcacugcagcagagagaagaggaaggagucagaaacacucuacugaggucagugacaucaaacagaaggaauucccaugcuucaugacauuaacaagaugccugcugaugaaacagauuggcuggagccaggcacaugugcuuacaguccacagcaucuauccuaacaagugugaucccuuugaucugauuagaaggguuuuaggcaaaugcuaucuaucuagcccaagagugugugucucccaguuaagugacucacucauaaagaagagaagcuccagaaauacagaagcugcucuaagaaugcagaaacaaauacagacacaccuagggaguuaaucacaggauuuaaagaauuccagacaaucugugcagcugcaguaguggaggacauaguucaaaacugggacagaaaaagaaauggucagagacagcucuggaauuagguccucggugcccagccacauucugaguuggcaugacagaguuggugcuucuuaggagucgcugauuucagugugcaauuaaaaauuuucaaaaguagacaacucaacugucuuucuuccagacagccauaugaaaaauuuauaaagauacuucauaacaaaaggaaaaccagggaaaaauguagcccuuuaaauggauuuuucuuauuuuaaaaaguuacuacauuaauuuuucuuaaauguacauaugcauuauaauugacuguaguuucugucucaauuaaaauuuaagggcaagucuuguuaucaaauuaucuaaacuaggaguuuguaaacuuuuccuuuaaaggggaagauagauaguaaauauuucaggcuguauaggcauacggccucuguugcaaguacuccucacugccguuguagcacuaaagcagcuguggucaauauauuaagcaaaugaacauggcuacauuccaguuaaacuuuauaaaaacaggcagguauugggggagcagauuuggcuggguggcaacuguuugcugaccccuuaaucuaaauaaacuuauuagagucaauuuuaaaaagaaauccccagcaauauguguaacaccuagcacaaugccuggccagagaaaaucaggcuaauuuccuuuccucucauccauguguugguuuccagauccucccagauagauaacguacguacauauugauaccucuacccggacucugugauuaauggugagguggggagcacccgaguccucugaacugaacagcugugcagcaacaucugcuggguggaaugcuggaaggaccgcgucacacaccaauccuagcuaaaguuucacccaagucuucugaaaagaagggugccucuagcaucugauaaguuuaaaagcgaaguauccuuggcugaauugccugacauucugagcuuuagggaccauacuaccccugaauaggaguacuuagcaccgugcauaguaauagcuugacaaauauuagcuauuacauuguucagaaacaugauguaagaaccaaaugaguaaaggcugugagcagcauuucuaaaacagaaagacucgagugguaguuuccguagcaacagcaaugaccaacauuagcaguguauaacuggccuggugguaaguguuuuacauacauuuucugaugaacaaaaacaaaucaacucucccagauaaugauuuucuagaugugaaaacugagguuuacagauuguuaccugcccagggccaaagaacaaaacccauucugccuucagaacuugagcccuuaguuguuuuuacuuagacaaccauuaacagacuaagagcaacuguuugcagaacgccucauuuuucgacaucucacuugaauagacaccuccucaaucggccuguacccaccugcugccacggcaaugaauaccauccagcuaccauguuguacacuggaugggcugggcaagcccgucgguugcaggucucuuccaaguccagauuugguuucuuaauauuacggcaucuucgcucugggaaaguuaucagcuuucccuggaagcccuucucgcugcacuucaucucccucuuccucacacccaaaccacagguugcagaacacuaggagccaagacaggauguguaaaagugaagacugccaggaucacaucuucuggacagaggcaguuugacauaagguugcaccauccacaugaaauaggagggaugggauuacacaaggucaaccacacucacucgaggaucuuacagauacagcagccaaguaccucaugcuauagguaaggaaaccaaaguucagagaacggaacugacuuucccaaaaucacacagaucauuagccucauaaaguaaaaaaggaaccuugggaugccacaugggugugagauggaguccaggagaaaggcaagaugggcaaaagaauuuccagguuuaggguuacacacuuacagguccaggucuaccuaaggccugaggaguuaggaaucugaguugaagaggguaagggccagagaaaaggauucagagcuuaaugggaaaaaccacuguacagcaaauaauugcucuuuaaauauacccaaccucucacacacaggagguaacaugaugagggucaaaaguauccuuuuaggaaaaauauccuuuuaggcugggugcaguggcucaggccuguaaucacagcaguuuggaagucuggggcagguggaucacuugagcccaggaguucaagaccagccucagcaacauggugaagccucagcaacauggugaaaccacaucucuauaaaaauuagccagguauaguggugcaugccucuaguccgaggcagcagauuaccugagcgagggagguggaggcugcagugagcugagauuuugccacugcacucuaggacaacagagcaagacccugucucaaaaauaaaaaauuuacuccccaguauuugugagagauauuucuagugugucacccaaggcccucaugauuuuuccaccccaucccaugucccuucuuuacuaaaugugcaguccccugucaucacuccuguguagaggcugcacccucugucugggacaaccuugccccaaauccccuuuugcuuugauuccugcucauuuuucaggccaugcucccuagaaagucucuucugacaaggguucuucccaaagaccggcuugggugaagcuugagcucucccauaaaaugacagacuucuaucaagucacuugacgugugcuuucucugcgugugcuuuaugaagucuugcgccccuacugcccagacauaggcuugaucaaugugggggugcuuuagcaauguuucgugaagaaaucaggagagaacugggaaguagcaggcauuugguaucaaugugugcaacacaaaggaguuuugugagccuagaugcuagcaggucagcugagcaucucaagaaaccuccagcagugacuuuuuuuuuugagacagagucucacucugucgcccaggcuggagugcaguggcgcaaucucagcucacugcaaacuccgccuccuggguucacgccaugcuccugccucagccuccccaguagaucagacuacaggcgccugccaccuugccuggcuaauuuuuuguauuuuuaguagagacaggguuucacuguguuagccaggauggucucaaucuccugacccagcagugacuucuaauccauaccucgcuccacgaagaagcgacccacuguagccggcuguucuuggggcaucguccaagcacacagcccuccugcagcucaggucuggggagacugguacacuggcucucggggaggguuucugcggcagagcccuugcagaggaguucacgcuuccucaccccucguccacaggucuuggaacacuugagaagacaaaaaaguucuauuugcauucccauuagguuucaguagccacauuaaaaaaaaaaacaacacacuaaauauauuccugugaaaggugggauaaacuccaugaacuaaagcucuuuuuacgagaucuacuuaaccacccccauucccauuacccaccauacauaucuggcuaaaacaauuauuugaauucuuucuguaaauuauauugcuaacugcaaagaaagagacuagacucaacaccauguacuauuuagauuuacccucugcuauaaaggaauauauucucucauuugaaagaaccccuaaacaagcucaaaaauauucucucucccuccugaccccuaauucccuaacguaucagucuccaauuucuuuggcaccagggucggcuuuugcagaacacuguauuuccauggacgggcaggguggugcuuuggggauaaaacuguuccaccucagaucaucacgcaugagauucucauaaguaacaugcauccuagauccgucaccugugcaguucacaacaggguucaaacuccucugagaaccuaacgcugccacugauuugacaggagguggaguuuagucugugaugcuggccugcugcucaucuccugcugggcagcccaguuccuuacagaccacaaacagguacuuguucaugaccuggggguuggggacccuugugcuaacagauauguccuaacauuaaaaaauaaagcccuacucugaccucugguaguguauugcugaaauuaaucagaaagcagcacccuccagcauguaauauacgcuaaaggaaaacacagaagaacugucaucaguggcugcuaccuggccccaugguucaggugguaaaacucuugccguuuuuucauucuuccccauaauuuguuugccagcagugauugagcagugguugagcuaucaucugcaagggaagcuguagggaagggcuucuucccuucagcaccacugacauuuuggaucagauaauucuuuguggugaggagcuggccugggcuguguaggacauucaccucuacccacuagaugccaggagcacucaucuccccaaguugugacaucaaaaugucuccugguaggcaaacuuacccacgguugagaaccuuugcuuuagagggaauucugagcugugaacgacaagguagcucucugucccuucuaacuuuaaaauuuuauggcuuucacugggaauuugugaccauagcaaacuuuaugcccuacuuuucucuguauucuucuaacuuuaccucuuucccauugaagcaagaguuaaauaucucuucgaugcuucauucuuuguauuugcguuucccauuugcuuuggagaauucaguagccagucuucugauacuggaauccuuucuagcugugcucacgagucuggccuaaauggcccccacacuccaauuucuguuccucuaaggaggauucuaagcucugggagaggggugccaaaacuucagauuuccuaaagaacauuaguuaaaaugcagauucccaggcacaugaacucagggugauuuccaugaacauguaaacugccaagagcccaguggagagcaaagacaccucuacuuuugccuucauggggaccgagaauaguaacucccaaguuuucuccuguuaccugagaccaggguccaaggcuccauuguggagggcaggcauggcuguugcaggcuuggaccugagugggugugcucacuggacagagagaaugcaacacugcuuccuccuuuuggaagggcuucuuuugcacacacuggaucuuucggcucugcuggccuccagcacaggccuugcugcauguacuccauucaccuggcauccagcuuucagugcaaaacaaacauuaccaaugaagccaaacuuuguaugauaacuuccaaagcaguuacugugaaagguaaaccaccuauggaagccaugaaucaauuucagaaccaauaagauaaguuauucuaauuguucuuugagggauccagaggcuuauacuaaugugauugagauauaaauaaucacauuuaaucaucccacaguucuacaaauauacucccgccucugcaugagaagaaauacaugccacuuuaaaaucugcacaauucauugagccaaauuuguugggauuuuaacuaugugucagggacucuccuaagcauuaggauuagaaaaauuaaggcagcagccuucuuuccauuaaggagccuauaacacaguaaagagguggauaugugaacaaauaaagacaguacuuucugauaagugcugcaauggaagucaacauaaaauacaaugaggaggcucauggaacagucaucaaugagagagaaagagagggagguuugugcaggagagagggguacauuuagagaaggucucacagaggauauuuuuaaguggguacuuccccaaauuacuuuucugauuacaccugaauuuagugauagguuaaauaccuaccuucauuuucuuuaaaauuugccagaccaguuuuuuuuuaauagcuaucugucugagacuugguauauauuugaacgguuaucaauugaaacuuuuuuuguuuuugagauggagucuugcucuuguugcccaggcuggagugcaauggcucgaucucagcucacugcaaccucugccucccaggcucaagugauucuccugccucagccucagauuaugacaaaugcacuauuauuuacaagaaaaaaaaaaguguguguguguauauauauauacacacacauauacgcacaucuuuauauauaaagauuguguaauacgauugcaucaccacaaaccaaacacuacuuaugaagaugaucuaaaacauuggugaaugcaacacugcuuuagaagaaacucccauccauuuuauauaaauauauuuggcagaagauaaaucacaugaaagagacucccuuuaacugggaagauuacuuaaaauuagucuucaaacaauaguguggcuaaagucaauccaagaacaaacucacugagccccuccaaggcugccaucaucagcgguggaguuaccacuuggccuauaccccauucuuuuuauuuugugucuugcuacuguguaauuuugcauuugggguuucauggcccgcauaauauuaugauuuuuaaauucuuggaccauuuacaaaaaaguuaggcacacaaccgcacgcaaauugaacuaauuuaggauucuguguuauuuaaauaucugucugauuccauucagagaagaggaaucccuaugcaaagguuaaaagaaaaaagcaccucacgccuguaaugccagaacuuugggaugcugaaaacaggcagaucacuugaggccagccuggccaacauggcaaaaccccgucucuacuaaaaauacaacaauuagcuagguguggugacgugcaccuguaaucccagcuacuaagguggcugaggcacaauaauugcuugaauccaguaggcagagguggcagugagcuaucaugaggccacuguacuccagccugggcaacagagugagacuccuuguuccuccuccccuccaaaaaaaaagaggucuucauaucccaagcaagcuugcuuuuaaauagccaguaaauuuauuccuggcuaucaagccaaagucaagugaguaccaaaaguaaauuuguauuuuucaacucaaauguaaacuucaaccaucuuuuuuaaaaaaauuucuuuuagagacaagaucucacucuuucacccaggcuaauauguaaguggcacaaucaugacucacuggagccuggaacuccuggguucuacugaucuucccucuucagccucccaaguagcuaggaccacacacgugccaccaugccuagcucaucaucuucuauuacuuuuuaaaguauugcgucuaccuuugaaucacuuuccauuagcaguauucacagugagcuuucaucaucucauaacaacaaugaaggcauacaaguacaaaacuaaacaaaaagacacuuccaaaugacuuacuaagccgggcaggagaaagcguugcagauuuugggcucaguuacuggcuugguuuuugcacugcagaaugaggaauugacuugaguauuuugaucucgcaagcaaauggccuuuacauuuauguaaccugguaagacaucagaagugacaaagugaaaauuacagauuauuauuucaauuugguucuaaguuuagcuucugauuuaccagcauugugauauuuuauuucagauauggaauccaaauauuuuguggaacgcuuccuuuugaugaaauuugcaacuaauuugaauuccauuccccucccuaaaauaauauauuuuauauuuuaauaauuguaacauguagauuauugguuuucaagacugauguggauacuagaaccauaaauugauaaauacaaccuuuugaaaacagaaugacuauaaaggguaacaucccaggcaaacuuuauuaucagauuaauguucuucaaagaaaaaccauucgugaguuauauauggaaacccuaagauuuugccuuaacaugaaauaucucauacuucuuaagagcauggggcacauaaaagcaaagaguagaacucacuaaauauguauuaaaaccuaucagccagggcucugcuuuugcuuuuuuuuuuuuuuuuuuuuuuuuuugagauggagucucauucugucgcccaggcuggagugcaguggcgugaucuuggcucacugcaaccucugccucccggguucaagcgauucuccugccucagccucccagauaccugggauuacaggugugugacaccauacccagcuaauuuuuguauuuuuaguagagacggccauguuagucaggcuggucuugaacuccugaccucagugauucaccggccucagcccccaaagugcugguauuauagucaugagccacugcacccggccucugcuuuugcuuccuuaguggcaucccacugccuugcuuucaacauuaauuucaggacuucuuaucaggggcauauauuuuuuuaaaaaugugugaauaauuguauuuuuuaguuccccaaauagagaugcugccuccccuuugaauuguguuuuuuauuuacauuggaacuuugucuucaaauauaaucugagaaagaauaagucacuccugcuauaaugauuagcaguuaguccagcuccuggggcugaagcagguuugcuuucaggaggcacuuacgaaaaccacaucaaggccgggcacgauggcucacacugauaaucccagcacuuugggaggucaaggaaggcggacugcuugaggccaggaguuugacaccagccugggcaacauggcaaaaccccaucucuauaaaaaagaaaaaaacgggccaggcauaguggcaggcaccugcaguccaagcuacuuaggacggugagguaggaggauggcuugagccccagaggucgaggcagcagugagccguaauugugcuacugcauuccagccugggugacagagugagauccuaucucaagaaaaaauaacaaaaacaaaaaaucaacauuccuugaaguuaaccguugacuuuaauaggacuuauucaucugaauucuuuuucucuuggacacaggacacaccagggucugugagucaugcgaagggguugcuaaggcagggcaaggcgagaauuucacaacuggcuuccucugcauccuccucuuggcuggauuuagauucuguaaguggaaagcaaaucaaacuucucuccuucccaaggcacugugcucucccuggaauaccagaaagcuauuggaaauguucucaagaaacacuggauaugagaaagaccucauaaucugugacuaaaugaaacagugugaagagaugucuauaacaugauuucaguacagagggauacaaaaugauacucacgguaugugagucugucaaacacauguuugcuuacaugugccuagggaaacaaaugauauagaucaaaauauuaacauuggcuauugccuguuuacaaauuauggggauuaccuuucuucuuaauagcccauugcuuuuaaaauggguauuacuagaaaauguauuaccuuuuaauuauuuuauauauguauccuaaaaaaguauuuuuucauacuuuguuaauuagcauggaccuacagauaggccuuucagacauaagaauuucuucauuuucuguaucuuugcucugucucugauucuaagccuuauuaugcuuagugggauggaaccaguaggaagucucacugucaccaggugcucugaauaauaggaaaugagagaccaacauucaugcugugguuucaggaacuuauuuugggcacuuguucuuccucccaaaugagcaagugugacaaugguuuaacccccaaauaugugacauuguucacaucuaaauaaaacgccuuccuucuacucacccaguagaugguugcuguuguuccuuccuugcaaggguugucucagauuuaauccauuccucuagugagagaaccuuugcugaccuuaccccugaggggauauccauguuucagauagacaucuuaaguuugccauguaugcguccucacuugccuugacccuagcuuuuauaacuuccaaauggaagguuaauaaugacagaaaagccaagacuggcggaaacuaaaagcugaaaauuaaacauauauauauaauauaaauaugcuucuauuuguaaauaauucaauauauuuuauauguuuuucccauaaguuuuagauguguaacuuuugagccuugguugugguugauuugagcuuugugagaguugauuccuuaccacauaggaaaacccuuaacuaaugccauaauauuugcuuuuauggugaugguucucauaaaagacaguucuuggguggcuuauuuaaaccauauuauguuaaagacgccuggagugaaagaaccuguuuuaagagagacagacuuuggagacagaaugagaaaaucaucuaccuccaccacaggagacggagcacucugacugcacgauacuccagguauaggcaggucuuuuuguggcugguggaguuccauucaugaccuugggaagugcauacuuccaagcuaucccuggauuuuugccuugcaucagaaucuggacaguguaagauaaaaaucagagaucaagauacaggucagacccuggaauuccagaaaucuuacugaacauuuuaaagauauuuacaugacauuuugaccuuaacauugguauacuucauuguucccaaguauguuuuauguugacuuaaagcuuucccaggacacuuuaaaaugugucccuucauguuaucaaaacugugauuuagguagaugcuaaagagcaaaacacgauugacauuugccauaagcccauaacguauacacaaacacauacauacacacacacacucacacacauauauguaucauaaagaagaaagaaagguuauacuguugggucuaaacccuaacuuaaaaaccuagcauggugaacacacauagucguacccuacagaaaauaguuaaaacugaaucuacauauauauauuuuuaugaucuauccuaggucacaauuuacaagcucucuccugggugcuaguggaaguugaaacaagggaaacacuccaaaacccacagaauacccccacuuagaguugcuaucaucaacuucagaauccaaauguguuuccaauauacuuuccauagaaaauuuucccaaagagaauuuguuaacugugugcuaggaugagcagauaagaagaaaagaaacauguucagaaucagcaauuggaauacaugcauuagaauagacuuaaccuccaaaaaggcaacaacuuaggauaaaucugaucccauaaagucugacuacuaaaauaagagcaaucacauauugggcacuucccaagugccaagcacucugcagccauucuuaaugcaucauaaaacauucuucuaacaacucuauaauguagcugccuauauuuucauugaaaaaaaaaaaaacuggagagaaagaacuugugcaagaucacacaagugacuagggacugagcuuaaguaaagccaccaaccaaaaugugccuacacaaugcaauguaucaccuuguuuuugauguaggaaaagcaucugucugccuucuuaaugcccucuuaacuacuccucuuucuucuuuuuucuuuuccaagcugaaagcaugaauauaaauagcugguucuuucccacuccaugaaucuuguggaaaauucuuuaccacuagaacugggcauucaugcccaagaggcaaagcugauugccaguuaaaaaauaggaaccccuggcucugucucccucgggugggaucccaccuccauuagaguuugguggguggcagcuguucaaggcccuucauuucaccagaucacucuuuaggaugguacaaaaugacuucuauuuugcuacuggcuuaaaugucuccaggaguauuaugacuaacucuuaagauuccaugguguacacaucaguuuguagagcaacaaaacaaaucucgaugccuccuagaaauaaucaaauguuaauagauggaucuguguucccccauccaaaaccaaaucaauacaaaacacaacagguaguaccauuacaugaacaaaugcccaguuaucaguugccaauaaaaaaaaaucuugaaaucaaagucuuaggagucuuuuauuuugaagaucuuucuagucuuugcuuuuuuuuuuuuuuuuuuuuuaacuuucgcagcuaagucauacagcuguucuuggaacccuguguucaacuuaacacaacauuucacacauguugaauaaauacuaugcuuuccuuauuuccacaguauuuuugaauaaauaguaugcuuuccugcaguguuucuguuaauguuuucaucugauauuaaguaaauacagaaacuuuacaguuuuauucauggucaaacuagaauugugagagcaguuuuacauucagaagaugauccugaugcugguuaauaauucaauuucauauucgguuaaagcaguauuucaaauguagcacuuauuuugccuuuuuuuuaugcaacaaaaaugcagagaccuuguaccacagaaaauuaugcacuguaccguauuuacuuguguggcaauacaaugugagugcaaugcauaagaguuacagugcgcuaaggcccacaaggcagaaugguauugcaguacaaagaggucgcaucacacacauacgcacauaguaggggcaagcuuaaguauaaaugcuauacagaaagaaauuaacuuacucaacugcacuuucuaguaucaccccauuccucccauucaaacuagauccuaauauuuucugccauaggggaacagauccccaauaaaaacgcaaagaaaauauaaaagaacauuaguucuugccuuuugagcuucuaggacuuauguucugcugauuaaaaaaguaguuugacaaauuuucaacagacauuugaaauauauuccccuuucaccuuuuagacagauucuagagccuaagccauacauggccugugguuucacugcaaaacauuuuuaaauguugcugugaacagcaggauguguucaagaaaaaaaaauguguuuaagaaaaagacugugaugauaaaagugucaccaguauuaagcaaaaacaaccacaugucaagcuuccccagaccuucacucaagccaaccauacaaaauuaucaaugcaaccaacaagaagggaacucacacaaucucccauugucaaauguuucucugugucuguauccguauccuccucuuccuccccugcugucacucaggaugcccuguccuggcuccaaguccaaguucuuuacuacacacugauuccaucuccccucaucuccaccaggaugugaccaccguaguugccccacguauggcuacugagugcuugaaaugcacucgugugguugaagucaaaagccuuuuaauuuaaauaaccaugugugacuaauggcuaccauacuggaugcauggcuacggaugacaccccgccucugacacccaucuuccauacuacauugucuacuuggcaucuccacuugaaugcuuaagaguauaucaaugucuaacuuuuuucugccucccugaaaggcugcucauagggaauacccuuccaguuguuuaggccaaaauaaaaacuuggagccauuuuagacuucucuuuuucugacagacacucauauuuaauagaucagaaaugguguuacuuuaacuuuuauccucucucauaucuuaccaccucauauguuguugcuccugcccugaucuaagccaccaucaugucucuugugaccuccacggucaagacaauaaaaaaaaaaaugacuuucgggagggggagaagugauaucccccaguggagaagaugagacagauucauauauuaaaaaaacacagucacaguuauuuggguuaaaaaucaagugcuagggccggacgcgggggcucgcgccuguaaucccaguacuuugggaggccgagguggguggaucacgagguuaggagaucgagaccauucuaacauggugaaaccccaucucuacuaaaaauauuaaaaaacaagccaggccugguggugggcaccuguagucccaccuacucgggaggcugaggcaggagaagggcgugaacucaggaggcggagcuugcagugagccgagaucacgcaacugcccuccagccugggcgacagagcaacacuccaucucaaaaaaucaagugcuacagauccuauaaaaggaauugaaauguuuuaguaaaucugaggugggggaggaaaucacauuaucaucuaaagaagcuuuguagcuaucacuuauuaauaacaaaucucggugaugauuauagcgaagaagacacaaagcaacaaaauuugaguuucuggccaggcacuuugggaagcugaggcaguaggaucuuuugagcucagaaguucaauaucagccugggcaacacagcaagaccccauuucuaaaauaaaauuuuaaaaaacuagcuagguguuguagugugugccuauagucccagcuacuugggaggcugaggcagggggcugcuugagcucaggaguuggaagcugcagugagcuauagucacaccacugcacuccagccugggccauagagugagacacugucucaaaaacaaaaacaaucaaauacuucuguuuucuuugaagauuucuauuccccccucugaaaaagacaaacuguuacacuguguuucccacaucccuuuuccuaaacuugaaaaugaggauccucagcaaaguaaaauccuugaacuaaagguaagaccagcaaugaucagaauauuaaacagcaguaagggaacaaauccauuucauaauaucaugguaauacaaaacucauguaucuggccaaaagaaaaagagaaauaacuuacacaauuugcuguacauguucuuaggaacgugcagcuuuaaauuaacucauaaaauacauaguagcuauuuguaugccuguguauguguguuacuauuacaguuuuauggccaguagcauauagagcauauuguuuauaguuuauuuccuuaacauauuaaugcauucaaugaauacauaaaugaaggccucuuaacuuuacaaaaaucaaaugacucaagguuugccuuuaauguauguguagcuauaaauucacaugcagaguucaauguguuaucauguagaccgaaagacaauauuuguacaaaccagcagaaagcugauguaagaauuuacuuaacaucagcucguaaaggccuuguaaaggaaguaaaaacuuaaacaaauaaguaccaagacaaauauauaaaagauaaguaugugccaauuguagcauauuauuugcuucucaauaaguaagaugcucuuugcccccaucuuuauucuguguugagaagaacagugaccaagaguauccuagaaauccucuuaucucuuacuguuugaugccugcaaauacuuaaaccuuuggagauuauuguccacuugucucauagaaucucugugggaaaguuucucuuucacccuguucuuaaaaaaaaaucagaauuuucucaaaucaaauccacccucaaaaacugcuacauaauuucuaaagcccagugcaaaaugaaaauucaacagucauuguuugaaaaaauuaagaauuucaagacagugacagugaagcauuaaaccaaagggcgcuucuaagcacaacguccucugcagcugggcaggucccaugcccaugaagcuaguccugcccagcuaaauccagguuuucucaccuggaucaguuuuaagacacaauuaaaaauuuuucaaauucgaaaugacccugcaaucugacaaugacuucucucucguuucaugguuggagaauauagcccccaauuugguggccuugauuauaucucagcacgugcuuuaguguguccaucaccaucaaccaaaccacagacagccucucccacugauguggggaaacaggacaacccuggagaggugugcauagaaccaccuaagaugcuaacuuccucuacgaaugccagggaacacaucuugggcaauauguaacuugaaaaugaucauucccauuguucacauuuuagaacauuuucggugaccaugucaagaguaguccauugcuuuucucagcauuccuggagaacacaaacaugcucaggguacaggagcaccgcaucccucccguaauggcaccacaucacaauaaugccauugcuuacaaccccgugccgcaugucggaguguauagccaagcuguuaaaugcacaaauuuggaaagaccgccagugauucaaucuacuuaacuggacuuaguccagagaauuuuccagccaacuggcauggagucuccaauuuacagcuggcaagcaaccuccuuaaaugcuuccagguccuccauagagauguuuaaugucuaccuuuaacacacaaaccaccugacuucagacacaacacucagcagcucuaaccgcagggugcagaguuauaaaauuuacagcuucuuaaguuggaaaaccacagacaggggcuggaaucuaccaacaacucucugaaggaaggggaugcaguuucuguuuaaggcacauaaaauuaaaacaaaggauaucuucaauaaucacggguaaaugauucucuuucuuucguccccacuuuuaauuuuuaauguuaaaacuuuuuaaaauuccuucagucagcuuuguauuuguuucauuauuuaaggccucuuuuuuucuucuucuucaagaaguuguccucauuuuaccauaaagguuauggauaaauuuuaaagacuagcuuuuuauuuaaugcaugcuaggaaacucaauuccuguccucaauaauguauucgauugcuuuaaaauuaacaaugccuauugagugcuuauuaugugccaggcaaagcauuguacaugcauuaucucauuuaaaauugauaacgacauuaagaagaaggugcuauuaauuccaauaguguagacuaauaaaccaauacucaaagucacauagcuaauaagucacagcaaugggacucaagucucuggucuuguuuaacccuaaaaccucacaucuucacucucacaacauugccucucaagcuuugaaacaccaagcccaggauucuaauuuaaaauucuaaaaacuguguuaacugcuggaaagacaacacugggccucccuggugugcugugacauuuacuuugugacacuggguuugaaccuaagaauuuuauuucuugaacauacuggcaucuaauuuaagaauacuugaucuccucaaucaauuuuccccuggauuuauuuauaaucauuguuuuaacaacugaaauauaauagacuuuauugguuggccuuuucuugauaaagcccaaauugcaccuuacacuccugugucucacggaaagaaugguuuugugguguggauucauguuuuuguaagcucaugugauuuuuggaaacuuguguuagaauucagcccauuuucuuugacuuauuugcuucaaagcuggaagaacaugaccagguaucaucauugcuauuaugugugagugauugaauuugacaagagacaguaauacaaagacccugaucagggauuuggaaaugcaucuguuaggcagcuucaaaggugugggcugacacauugaaccuugacuacaguucuaauucaacucaucaacauuccucagaguguaguggggagaaauaguguucucuaacccgucacaaaaguauuugccaugaauuaacuggaggcccccacuucaaauagcaaauggcaaucucuagacaaaugacgugccaucgcaaaaguaccucugaaucguccucucgagccugacuauucuaucaucuguucugaauuaauucuccauuacuucucugcuucuuuugugucuugugucuucacucaguccaugcuacuuggcuaaucucccuucccuuacacugauuguaucuugaggcacuuccuuacucauuucagccccuuuaccuuggggagaauucagcaggcagggucacaaaggagcuggaugacaagguaauacuucgucaguggugcucacacugucaucucauugaucaaugugccuguccaccugguccccaccacccugucaucuccuuuggccaaagagugcaggaaguuguuuauuauaguaauuuucuuuagaugucucuucuugccuugaaacuaggcugugguuaaccuauuucucacuuacuaucaugagaaaggcugcugucguuuucagcuucaggauucucccuuauuacacuaggaaugggcuuucaaagaguuaaacgcccucuucuucugcuaaacauagagaaaaaaauuccuaacauaaacgagagcuuuucuauuuuuuaaaacuuuuuaaaaaaggaaugcugugaaaacacagguggucauauuucagccauacaauagcaaccuguauuaucaugucauacugaaucacuuuguuuaucagacagggaugaaguuacuucauaaugaaacacucaugaugaauuuccucaccuccacuccaacugcaugacagcuugauagagaaugugacucauucauuguuguguguguguaugugggugagagagauacagacaaagagacagagaaagauugaaaugggggaaaaggaagaggagagaaaggaggagcaugaacuaguaagauaccucaucucuagucacuucuagagaaugugucaucucuaaguggauaccuuagcuaaucaugaaaaaaaaaaaaaaaaacuuguguacauuuuaauccuuauugccaaggucuccuaaaacuguguaugaaacaggccuuuuccauauugcuuaaacaaaggacaaagucagugaccuuaaauuaccuacaccuaaaccucaagauggaaaaacauuguuuucaggcauacucaaaaagcccagcauauguaugugucuacuucagaugaacugucaacaaagccuuguguaaaguuucacucugaucuucaguuuucacaauucaaucacuugaaaauuuaauuucuuacaacacacacacacuuaauuuagauauucaggaguggagaauuaaaauagauuuaguuuuucucaguauucccaaacccaauaaaauaaacauaaugcagucacugauacauaauauccuaaacucuauuaaaauaaaagcuaccuuuuaaaucuucuggaugacuaacaaguacacuaguucagugagacaucccuuagucuuuaugccagacuuauguuguagaaaauaaguugaaauacauggaaauuauuuaguuuuauauuaacuauauucauagugaucucagaaacuaugugacugcuaaaucaauauuuauuuuuaugcuaacgugcgcauguagcuggcuaguuuuuuuuuuucugggaaauacagaaauauaacacuuggucaagaaaauuaucuccuuuucuccaagucacuuauaugcauauauguguacguauuucaagaucaaaaacuugauugauuuaaauaaugccuaagaaauuuaagaccuaagacaaucauacaaauccuugauuacccugagguauaucccuuugacaccaaggaaaucaauggggccagcacuguauaaauugucauccaccuguugcacauguugaaaccaucuagaaccaaggacccaaggagaauggaugucuguaauacagacugcauuuuaaaauuggacuggcaugugacuuagugauaaaagugaaggucuguuuucuauuuagcuuaaauuuuuagcuucccaggaagacauccuauaaaguuuugacauauaaaaauaaccagaagcagaagacacuuuuauuuggcaucaaaccaugcacuuauuucuugggguuaacugacagcagucaauuauuuccaggaucgcauuauccugccuuguacuacaaaacaccaagaaauaaguggaaugauuggcaaacucaacaccuugaaagggcaaauugcuauucaucuagauugagguaaguccacugugaacuaacuggucagugacuuccuagguguaaguuauucacuucaggaaagcaaguguuuuaggaagcacauugauuccucaaaugcauuuuaggagaucaaauuucauuacuuuaaaugcuauuugcuguacuuaacuuuaaaccaugugguugucaaggccagucucaagagaugaucagauacagugguuuuuaaaauguguguuacagaagccucaggaucuucagaggauuucagugcugaaauggggcaaggacaggcuggguucuggucccuucacuccuggcuucagugaaagaagcucuccuuuuauguuuugcuuccauguaaaauuuuucaauuugaaagaagauugcaacgaaugaauuuuaucauuggauguuguucacuccauacauuuucuuaaacaucccacgauguuccagacacugugccaauuguggaagcuacaaguauaaaugagucauugucugauaacauaggguuugggggugcucuaaaaguacuucaggacaguaguauagacacaguagaagacauuaguucagucuggggaaaucauuucugaaaugaggaaacugggacccugaucauuucagugauuuuuccaaagucacauaguuuguagcagagcaaccuauaucccagcuauuuaugcagaugcuucuugucuaacccauguugcuucccaaaagaauggaauccacguaccaaugcuuguuuuuuacauuauuuaaagacuuaaggcuguaaaguuuuggugaaaagauuuaugucuuaaccuuuuuuucuuuuuuuuuuggagacagggucucuguugcccaggcuggaguacaguggcacaaucacagcuuacugcagucucagccuccuggguucaagggauccucccuccucagccucuggaauagcugggacuagcagcaugcaccacaacucccagcuaauuuuuguauucucauggagacggggguuuuuucauguuucccaggcuggucucaaacacccaugcucaagcaauccaccugccucagccucccaaagugcuggaauuuuugcaccuggccugauugugcaucuccaauaucuaacacagggcuggacacugaauguuuuuuaaaccagacaaugagaggaagugaacagaagaaaauuguuuugaugguaauuaccuacauugauacacaugaaggcagaugaaaaugaaauuuagcuaagauaugggaagaauaugaugucauacauaugaaagggaaaaaaaagaggaacauuacucucacaguggcauccucacguguuguggaaaacauacacuucugcugaauuuuacaucaucauaaggacuuagugaauauacaauaauuuuagguggccaaaagagauggugcuuucauucauagauuuauucuuucuguggauggaacagcauuuuucauuuuaguagguucccacagugauuuuagcauuucacaagauuauaaaauagauuuaauauuuuuguauuggaguaaauauauguuuggcuccaaaaguauucauuuuggcucuucauagcuguuguauggaaaggccuaugaacuuuauucaacuuccuuuaaagaauacagccauggaucacuuggauaucaauauacaguccacuuuugggaaaauauaauuuauugcuuauuauaauuuuauguuuuuagaauaucuguguuccauccauuuuagagagauacaagcaugugcuaaaaacugaccagcaauuugaugauguucucuagagaacaauaaaguguaauuuaaauaccaaaggcauuaaccuaaauuauuugaaaagauaucauagacaaaauacuagauuacuggaguuuucuuuuuuuuuugcuuugaauauauuugcaacuuuugaaugaaaccauaacuccuuuaaaaauacaagcaaggcacguccaauuaaucauacaaguuuccauuuagauugcuuucagauaggucaaauuccuuggacauuaaguuuuucuugaaucuauugguagaaugagugcauaaagaaagauuuuggaaaacaauagccaggcaaacaugaccuuauuccacuguggugaaacgacaauuuuguauuacuggagauauugcuguaguucuuauucuuuuauguaguaguaaauaauuauuuuuaaaaacauauuauacauauccaauugaaccuggggaagacuucguuuuuaugauuuuauuuagaucuacucaacauuuguccuuacaucuuauuuuuguuguuguugucacucaaggugcuguccguauuauuuacaaagagauagauugaugaaccggaucaauucgagagaacucuaucaccaguggaggccaaucuuccauuccucaaaaaaaacuuuucuuuuuuuuuuuguuuuuuuugagacggaguuuuguucucgucgcccaggcuggagugcaauggcacggucuuggcucaccgcaaccucugccuccuggguucaagaaauucucccugccucagccuccccaguaccuaggauuauaggcgcccgccaccaugcccagcuaauuuuuguauuuuuaauagagacaaggguucaccauguuggcugggcuggucucgaacuccugaccucaggugaucuacccgccuuggccucccaaagugcugggauugcaggcgugagccaccgcacucggccgucucaaaaaaaacuucuaacuaucaggaaaaaucuuacaccuggugaaaaaucuuaaaguuuacuuuuugucagggcuaaaucauguugaugaaugacauacagagcuaugcauggauuaaauaaaguacgaauaugcagccaaauaugaaaaaaugcucaucaucacuggccaucagagacaugcaaaucaaaaccacaauaagauaccaucucauaccaguuagaauggcgaucauuaaaaagucaggaaacaacaggugcuggagaggauguggagaaauaggaacacuuuuacaccguuggugggacuguaaacuaguucaaccauuguggaagacaguguggcgauuccucagggaucuugaacuagaaauaccauuugaccccgcaaucccauuacuggguauauacccaaaggauuauaaaucaugcugcuauaaagacacacacacacguauauuuauugcggcacuauucacaauagcaaagacucggaaccaacccaaauguccaagaaugauggacuggauuaagaaaauguggcacauaugcaccauggaauacuaugcagccauaaaaaauguugaguucauguccuuugcaggaacauggauggagcuggaaaccaucauucucagcaaacuaucacaaggacaaaaaaucaaacaccacauguucucacucauaggugggaauugaacaaugagaauacuuggacacaggaaggggaagaacacacaccggggccugucgucgggugggggcaggggggaaggauagcauuaggagauauaccuaacguaaaugacgaguuaauggguacagcacaccaacauggcacauguauacauauguaacaaaccuguacauugugcacaugugcccuagaacuuaaaguauaauaaaaauaaaauaaauaaauaaauaaauaaaugacucaagguuuaaaaaaaaaaaaacuuaaauuacaaacagaauuguggaagacugcuggaaugguucuguguuuaugaccaaaacuggagagacgaacaacagaaaaaaugguugcuugucaugaagcgguaaaaaacguauuucucaucaggagugauuugcacuuugcucugacugcacacggcugagacugucagaugcauguaccccuguuucccuauucagguucacuuucagcuacagaacuugguuuguguacauuugcuuugagguggaucgaaggccucuuggcaaaaauuaaugaaguccugcucucuaaaacugauaccuucaagccgaaaaagccccucaaaagaaaaagaagucugcugcucagaugcuuaguagaaaagaaacagguaacacaauguaucuaaaaaaggacuuaaaaaauccagaaaucuuuaauaagagaguucaauuucuaugccuuagguuuaauuaaaguauaauaucaggggcuggauucacuguugagcuccaaacuauccuggccauagucuauuuugauugggaaaugcuaguaucuuccucucaaauaaaaaugcugagggggcuggaagaacauuuccuaauaacagcuucucuugaguaggugguaugagaucuuugagggacguccaccaaacagauggacugaugggacuggguaucuccaguuaggaagaugaugggaguuaacucaacgaucaaggcugcaaacucaaguaucuccugggacuagagguuuucuuaagaguuucaaaaauucauauguauaagucaccugauauuaaagcuuuaaucuauuuucuccauuuuaauauuauacauggcugggcguggugcacaccaguaaucccagcacuuugggaggccgaggcggguggauuacuugaggucaggaguuccagaccagcgugaccaacauggugaaaccccaucucuacuaaaaaacauauacaaaauuagcugggcaugguagugcacgccuguaaucccagcuacuugggaggcugaggcagaagaaucgcuuggacccaguaggcggagguugcagugagccaagauugugccauugcacuccagccugggcaacaagagcaaaacucugucucaaaaaaaaaaaaauguguguguauguguguguguguguauauauauauauguacauauauacauacgauugauagauagugcgggccuaaggcugaacuugacuugugaucaccaguuugcuaaauauggucucagguuucauauauauauauauauauauauauauauauauaaaauauaugugauaugcucagaaggcaaaauaauggcaauaguaauuaacauuaugggcuaaguauuuuguaggcacugaacuuaucuucaguuauccucaucauggcccuaauaauuagcugguauuguuugcccauuuuacaaauauagacauuaagugacacagagauuaagaaacuugccuaaguuauguagcuaguuaagagucuguacucucagccauucuguguguagaacaucuuggaauuuaagguuauguguuuuauuuuuaacugucugcuacuguucuuccuuaguaaauauuuaaggcuagugcuacuuaaucacuacucuuggagacuaauccuucauuuucuaccaucauggccuaaaaaaaaauuucuguaucaucuacuaauaguccuuugacauuauggaaaaugcgaugcuuuugaaaucugaauaauagauugcauggucuuaaaacuaugaaacuggcacuuaguggguuucucugauugccuccacagagggucucaaaugucaucaagggaauaaaguagcaaagccuauuguaaacugaauuugcauagcucuugcguaugagauucagacggauuuuaaauaccuuaaaaucuggauagaaacauauacgauuggagcaacagcaggaagaacagcuaggaugccaucccuguugccaugaaugagggcaucuccacucacgccugugggugugcaggugcagggcaaaaauacaugacaagaugccagcgugaugagagauuugcaucuauauacaaauuccaugauaucugugaagauccuguuuccagcacaagcacgccucuccgugacaggugcaugcuccucuuuauugguggugucaaccaaggcucaacauuucuucacaaggcacauucuggauauugcaauuauuuggcuacucccaagaggcagcuuaucaaagaaaacuuggauccaagugcccugcucaguuaacaaaugauauacuacuauacuacacuuuagguauuuuuaggaacugauuugcauauucauuccaaggcuuuuuucaugcauuuuaaacacacacucaaccgccuacuugacagcuacucuugaauaucuaagguacauugcaaauauaugguggcuaaaauggaauuuuuccccaucccuaaaccuguuuccagucauccucaagacaaugauagugguaaaaccauccuccagaugcucagggaagaaaccugagacucucucacaucuuucucccucagaguucauuucuuauacaugucuaguaacuuuucuagcuuccaguucucuaccauaauacacugcaaacagauccacuuccugccaccuucacagucaccaucuguuucagcgucuauuacuccuuaccuggaauucaagaaccauuuuccuauuuccccaguuuacuucuugccucuccaaucacuuauuuacauagcagccugguugaauuuuuuuuuuuuuugagacagagucucgcugugaugccaggcuggagugcaguagugcaaucucggcucacugcaaccucugccuccuggguucaagugcuucuucugccucagccuguugaguagcugggacuauaggcaugcgccaccauacccagcuaauuuuuguauuuuucaguagagaugagguuucaccauauuggccaggaugguguaaaccacccucuuccuugacauccugauguuguuaaugggaugaaauccaaacuccuuaccaugguuuguauuaugugugggccacccccugacuauacccaucucacaccucaauacuuucuuuucugacuacacuauagcuagauucuccuauuuuuuaguucuuauaaaauauuaaguugauucuccacaucagguuuuauuuauuuauuuggagagagucucacucugccacccaggcuggagugcaguggugcgaucucggcuuauugcagccucugccucccaagcucaaaugauucuccugccucauccucccaaguagcugggacuacaggcaugcaccaccacgccuggcuaauuuuuguuuuaguagaaacaggacuucaccauguaggccagucuggucucauacuccuggucucaagcaauccaccuaccucagcaucccaaagugcugggauuacaggggugagccaccauacccagcccacauggaguuuuaaauuguugcuuccuccgcgugaauuuccucugcucuuuaccugguugggucuucucauccuucaaguuucaccucacaugguaauucucagauaauuccucaccaacucucuaauucaaaaagucuguuuuuuuaucucauacuuuauuuucucucaaagaaccuaccacaaucuguacaucugccuucauuuauauauucauuuguguagugcuguacuguacccuccaacacucuaaguuucauuauagcaggaggauuuucuuuucuguuuauccacuacucuauacccaguuuacugucaaugugaaacucaagagcagcucagugcaugugacacagaggaacgcagugauuucuuuuguuugagauggagucucacucacucuuuugcccaggcuagagugcagugaugcaaucucggcucacugcaaccugugccucccagguucaagugauucuccugccucagccucccgacuagcugggauuacaggcaugcgccaccacacccagcuaauuuuuguauuuuuaguagagaugggguuccgccacguuggcccagcuggucucgaacuccuggccucaagugauccaccugccucgggugauuuccuaauguguggacauuuucacuauucugcuuucugaaguucuagcaaaucuaagaauccaugagggaaauuucaagaugucaucuaauuucacccaccauaacucaacacacagaacacaaacucccacacacuggguaagagaaauucauuucuauugcuuuccccaugaaccacugugagcugcagaaggucauuaccaauaucaugguagcacgguauuuguucaaagaauuauccaggcccgcugugcauggaacugagaaagaugauaaauugagugcuucaguuuagacagaagaaguagcuaccucugaaaaauugccuuauucaucacuaaucugaccaaaauacccugagaugauugaggacacagcaugcugucagcccagaaaacaagcacuaugucgcuuuccucagcaccaagaacacaguaagugccaauagucuuaugugaauuaacauauauaagauagaggaaaauaaauuauuuuaaguaaaaaucaucggacaaguuuaugaacacaaucuuccuaauagucaguuuucagaucaacccucuaguuaccacagaucuaugucaguauuggucaaaauacauggguauguucucaguguuuuaugcauucaaaucuggaugacagaugucuccaaagagcaaacuaucuauuucccaccucuaguaggcuuuguaccucccacagaggcaaccauuucacaaugagaaaaaccauauaaugacaaguagcugagccuugccaguauuggugcuauauuaagauaaugguguggccaagugagccaggaagacuuacguucaaaccucaguccuaccacuuacauguaacacagucuguuuaaggcucgguuuucucaucuguacaauggggauuaaguaacaauaccuaccuuccuaaggugguugugggcauucaggaaaugaaugcaugaaacugaucacagaaugccugaaccuacucuauuacagucaugauaacaacgauaauaauaauaacaguuacacugauccuguguuuauuugagaagagaacaguaaucugaguguuacauagaucucauacuccuggguggaaaagacucugacuccaguucagcucuguuuuuuucccuagcuguaugagauaggcaagucuuuuaaucuuuuuuuuucacacuugauuccuuauuuuucugguuagugaaguccauuuucuaccuuaguuucacagguaacaaacugaaacuuaacaugacuccuaagaguagcuggauaugcaagugcucaguaucauuucuauacaaacugaagcaaaucgcuugcuuguaagagccaacagucagccccauuuuacaaauggagaaaaagcacucagagacaucaugaggacuaaagaaaauguuucuaugauaacagccuugcagagucauuuccagauauguugguucuuuuaauuaucauuuuuuuuaccuuuuuucccuuuucuuaccuguggggaagcuacaaacuacaaaaucaugguaguuuaguaugaugaaacucugcugacacccaggcaagcauuuucucuacuauuaaccccuucuccuaggccaguugaccuauguuaugaauagcuacaauggagcauccaaauggcagacauagacaaaccagcauaauauaaaaaguauucuugcuacauucuuuggcguucuugaaacccaagcauauuggugaaagguugaccucuaaauaugaaaaucaacccauucucuuggaggccauuuggguuccuguccucuucccccaaauggaaucacugucuucuccccuuuacacuuugaaauuuagccuauuaggaaacaccuuuuguuguuguuguuguuuugaaacagucuugcucuguugcccaggcuggagugcaguggcacaucuuggcucacugcaacuuccgccuccuagguucaagcaauucucccgccucagcccccacuaauagcugggauuacaggcgcgugccaccacaccuggcuaauuuuuguauuuuuaauagagauggguuuucaccacguuggcuaggguggucuccaacuccugcccucagcugauccgcccaccucagccucccaaagugcugggauuacaggcaugagccaccaugcccggccaggaaacaccuuugaacuagaaggacuggaguucuggcucaaauugcagucaacgauauaaauguagcaagaagcacugagaacugaauacacagaaggggcuuacuucaaagaccagcgucucauuugugggcccuggcgcguacagacguuccgggcgguugaaagagcgcugguauucaaacguggucccagcgaaggggaacuccccaggccagucgaugcuccagcccccggugagguaauacuuuugacugaggcuucgaacugcgagguaacuggaggaaaccugcagcuccuggauuucgaugcuucgggcgccagcuggaaugaggaccaccggauaauauucuaaauggaaagaagagaacaugucugaauuccaccccaugcauuggagaaaagggacuagaaauggcccgacauguaguguucaguuuuauagagugagguuuuuaaaucauuaucuaaauucauucuuacucuaugaaguaaacaugaucaaugauuucauuguccaaauaguaagaacacuagagaaaauguauguggcuucccaaagccuuccaacuauguuuucuguggagaacaaauacacucuucuccuucccagaccacaaaaggccacaaaauucaagaagacuuuucaaaaaucuaagaccaaagugggcggaucacccaaggucaggaguuugagaccagccuggccaguguggugaaacccuaccuuuacuaaaaauacaaaaauuagcuggacaugguggcaggugccuguaaucccagcuacucaagagggugaggcaggagaauugcuugaaccugggauguggagguugcagugagcugagaucacacuacugcacuccagccugggugacagagcaagacucugucucaaaaaaaaaaaaucugucuggaagaagcuuagaaccauguaucuucagugaugaaauucagaaaacagggaucaaaaguuuaauuucacucaacauauuuagauaacugcuucaaauauucauuuagcacugugaguagagaucacauaaguuucacaauguuucuuugcuuaacaaaugcacuuggacauacauggggccuggucggcauacuaaaaaugcaaagcagaaaggcauuuauuuggcauguuucuacgagguaauguaucgacgaaauuccucacaacuaucucccuuacucuugcacaagugaaaaaugccaccaucacuaguguguccagugaacuaguaaaaggcucaaccacauuuggcgugacucaaacuuguuugguagcaaaaguuguaucucauuaacaauaacaaacagcagcaucucucaccauuugcuuuaugcugguugagguacaggccuuuauaaaacuugcaaguugaauuaucaccuuugcaaacgccacaagcaucugaaacugcuuuagagccuaguucaugaucacaucccacuagcugugacaaaaacaaaaaacgugagaaaauaaaagaucagagaagccagaggcugggaauaauuaagagguauaugguucucuguauuuacagaacauuagggaagcaguacagcuuaugguuaaaaaucacagccucaaguuggacucacuugggguucaaaucccuccccugacauuauuagaugacugagcaaguuguauaacucaucuaaggcuuagacucuucaucaaugaaacuggaauaaaaagucacuauugcuacuaauaccagcugagauuauucaggccagcuguguaacucaaauaugaaaaugcuggacaauacacaugcaugcauguguacaaacauacacccuuaaaagaucaaagggcucaaacuaaaauuaaaauggaagagaaaaugagcacucaaagugaaaggaaaaauaacuggggaaaaauaguauuucaaaauacauuugugagauucuaaucauauaguaaagguacuuaguacacaugcaauaaaaguuuauuauuuacauucuuauuucauuuuuacaacuccugugcaaagcaggauauagcaucaucuccauucuauauaugugcaaguagaguaaaaaauaaacuaaaauaauuggacaaggcucaugcaacaaguaaaugaggaacguagauauggugcucggccaggcgugguggcucacgccuauaaucccagcacuuugggaggcugaagcgggcagaucaccugaagucaggaguucaagaccagucgggccaacauggcgaaaucccgucucuacuaaaaauacaaaauuagccaggugugguggcaugcaccuguaaucccagcuacucaggaggcugaggcaggagaaucacuugaacccaggaggcagagguuacagugagcuaagaucgcaccauugcacuccagccugggugacagagugaaauuucaucucaaaaaaaaaaaaaaaaaaaaaaaagauauggugcucgaauccagugaaacacuuugcucuuucgcuccaugccaccugcucuucuccagacacacaaucucucacaccacuguucacgguacacacgauaugauaaaacacaagcaugcucauacacuccaaagcagaaacguucucuuacuucacaaaccccgucaauacaaacaucauuuuuguuuggggagcagggaguuccaucuuucacuuugccggacauugcaaaaaaaaauucaaaguucucagccuugcaguacaguuugcaucgaucuuccucuagaaacaaagagaucaagauaggaaauggucaagaggaaacuaaggaaaaaugauaggauugucaaaagaaugaauuaaauuuacuuagaaagcuaucaugaugaauauggaaaauguguguguuugcacauauaagcccauaugauguggcuuucgaagcaugagucccauguaacaauccauauaaaacuaauuuaagaguaauacguaacaauuuuauuuuucucauccuuagggauagucaccauacacaugaucgauggguuacuauccagccucccuggauaguaaaccuuucagguuucaaaggccugauggucagccacugacaauacagaaaugaaguaguguggcuguguucuaauaaaaucugaugaaacaaauacacaccagauuuggccagcagcccauaguuugaugacccugauuuagagcauggauuacuuuagauauuuacucagucuguuaagagaaaagguuucaggcaccagggagaaaaggcauacgguuagucauguuuguaaaacauauagagaaaaaaaaccaugucauaaaaaugaagagaaagcaaauaaacucguccugaaggcuacaaaaagguaacuucucuuggcccuuaagucccugagauguuucugauaucaaaggcaaaaauuaaaaaaaaauuauauuuauagagcucuuguuaucagaaaggaguuccuaugccaauuucucaaauagaaagagcucuucuuggccaggaauuccagauaacguuucucacaggagaccuucugugggugauauugagcgauaucccuaacaacaguuuuacaaacguguaaacaguuugcaaauaguugugcuucauaaaaccucucaauaaaagacaaacuaaaaacucaaacgugaaaggaguuaaauuaucacaguccaaauaugcacaugcguggguggguuaaaagguucucucccaucuauaauuuuuuuuaauagcagcuuuauuuaaugcguaauuuuugcacaugagauuagggaguuggaugacauauaugcccuuucuuuucucuaucauuuccagaaauuaacaaguuuuagaaaguuccuuuuuuuuuuuuuuuaaaagcacagauuccugggugaguuuaugaguccauuaaaaacacagaggaaagacgggaaaaaaccucacuccuguagcacagagauuguccacauuuaugaaaaagucuucccuuguucuucuaaauugcaggaaugucacaagacauucaagucauggucagucuccucugauauaaguaucaaaaggagacaaggagagacuagaaagccuuaacguuucugucucccuccacugagagguaagauccuaaggcagggagucuauguuugauucagugcauucugcucugcaucuagcaaagugucuccuacacaaaaagaguucaguaaacaucuguugcaugcaugaaugaaauugcaugcucccuacucaguggaaacugcaauaaaauuagugaaagaacuuugacaccagcaagcauuuucuaaauugcaaaauuuauuuguuuaacuuucuccuuauaucuucaacacagaauuucuuuaagggcgauaacaggacugauuucauaaacacuauguuugaaugaaagauguaaugugauaaaggccaaggaauauccacgaagccaaaccaaaagcaaagaacagaagaggaaguaaaaggagggacaacagagucauggagaaagaaccacagguaggaagcaugggaccucaagaguauacaaccaacagaaaggaaaucuuccaagucuggaauaggaagcaacugcagcauccgcugggaccugcugugcagcaugcuuccuacgaaaucacucagcuccugguagaaugccucuagugauggggaccuuguuacuuacagagggaguauauuuucauuuuggacaguuaauauuuauuuacuuauucauucauuucaaaaguuauaaccauuacauaaauauauaccaagugcuguucuuggaugcuggagauauaagcaagcucaagauagacaaaggcuuaguccuuguggaaccuaaauucuuguggggaggaagauaacagauaaaugaccacauaaaaauacauccaugcacugagaagagcuaugaagaauaaaacgggguaaaggguucagaaaacaauaugaaggaagaauauguugacaggcuguuaaggaaggucucucugaggagacaauauggcuagaauguucucagcccuugaauuaauucuguuaucuaaagcaauuugaaauaaauugaacauccuuccuauucaauagcucuuugaaguuuugaauguaagucguuucucauguacaguaaaccucuauagguaccucauuacuuccuccuaagacacagcuuuggaauugucaugucugucucuaucuauacuuccuggcaaacagucaugacccaaaaccacaucagugcuccugaaauggcuaggcugauacugagcaaagcugcacaauccucucuuucgauuuggaggcucuacuuguuauagugaugccuguaauuauauuagcuuccuuuaugaucacugauuaauauagguucauguugcgcuuuugcacagaacagcccauggauugucauuaaacuuagucucuuuccauucuacacaugggcaguugggauucacauauaacccuguuucaagacagcguaacaguuuugauaaaucuaauggauggaaguaaugaaacaacuaggaugaugacagcuuauucuacauagguaagagcaacuacauuaaacucuucugcuguaacuaauguuuuauuauucagucaaaauaaagacacauuaauuuaaaaaguaaaauauaagccauaacuuuaaguauaguaaguaccaagaaccuaguauaauuuuuauuuaugauucugugugugugucugcgugcaugcacacacucuacacacaggccuucccaugcuuguaaucaacugacaugucaguuacuguguacggugccucuaugggguauauaugguuucaugaguuuuuggucuggacaguucauaccaauuucaauuaagaucccugggagacuuaauugccaaaaugucaaagguaaguugagaaacaugaguucauuccaaacauaugaaaccuuggguuuacagaugugggagacaagagguaucuuauagggggaaaaaaaaaaaaacaacaguggaaaaauaaacaaaacccauggaaugaaacacugagccaggaugggucuggggagugaaagguaaacauucaaacucuuugauacaagcagcaauuucuucuguauuggucaaucacauuauuauccacauagagacuuauuugaaugucauagagaccaaauuaccuuccacuuuuguauaggguuuccacugguagaaccauccacggaaagguuugcuguuauauucugcacacuguugagcccgaaaauccaagcuauuuucauugcaaggguuaauauugcacagcugauaaauacggcuagaaccuggacagaauaagccaccauacugaggccugaaaaugaaauuaaugaacuuuaauguuaguaaucaaagggcucauuauuagucacaugcaauaauaugaagagaggcaaugaagaugagcacugccacaguguaugcaaaggcauacagucuauuacaggaauggaaguacauagcauacaacuuaacaccuuccuucuugaaucuaggcuagacauaacuaaucaaucaggggauuuuuuucuaguucuuuucauuaccacuguucacucauuaaaauuggcaugcuaaaucaaauuuauuugccaucaccaauccaauauuuacauucuguucauuuccuuaaacacugaugaaagaaguuuuacuuuuuauuuuauuauuauuuuugagauagggucucacacuguugcccagucuggaaugcaguggcgugaucuuggcucacugcugccuccaccucucuggcucagguuagccuccuaccucagccucccaaguagcugggacuggaggcaugcaccacuacaccuggcuaauucuuguacuuuuuguugagaugugguuucgccauguugcccaggccagucucaaacuccucgguucaagugauccacccccaucaggcucccaaaguguggggauuacaggugugaaccaaugcacccagccugaaaggauauucuuuuguuuuuaaauuuuuuaaauuuuuuaaaacuuuuauuuuagguucagggguacauguaaaguuuuguuauacaguuaaauugcgucucgcagggguuugguauacagacuguuucaucacccagguaauaagcauaauaucugauauguaguuuuucaauccucuuccuccuccaacccuccacucucaaucuuuggguccauauguacucaauguuuagcucccacuuauaaggaagaauaugugacauuugguuuucuguucccgccuuaguuggcuuacaagaaugaccuccagcucuauccaucugacagcaaaggacaugaucucauucuuuuguuuuggcugcauaguauuccauggugcauauguaccacauuucuuuauccagucugcuguugaugggcauucagguugauuccaugccuuugcuaucacgacuagugcuacaaugaacauauaccugcaugugucuuuaugguagaacaauuuuuuaauuuuugauuuuuuuauuucaauagguuguuugguuacauaaaaaaguucuuuaguagucauuucugagauuuuugugcaccccucacccgaucaguguacccuggacccauuguguagucuuuuaucccuugccacccccuacccuuucccuugaguucccaaaguccaauguaucauucuuaugccuuugcauccucauaccuuagcucccacauaugaaugagaacauacaauguuugguuuuccauuccugaguuuauggcagcacaauuugcaauugcaaaaauauggaaccagcccaaaugcccaucaaucaacgaguaaagaaaaugugguguauauagaccauggacuacuacccagccguaaaaaaguaaugaaauaauggcauucacagcaaccuggauaaaacuggagaccguuauucuaacugaagggauauuccugacccucaucauauuagccccuguguuaaggaaaucuguaaacacaccuaaauguucuuuuacuguauaugugugcucgucugcuacaugcacauacccuaucucuuggcaucagaagcuguucaaacauggacccaagcuaccucuccagcuuucucccauuuccuaauacucucaguaucuucccacacuuugccaugcaccuauuacauagaacgucagcacacuggggagaaggaacagaaagcaccauuugcugcucuccccaauccagcugucagucauagagauauuuugaguauaauaugacuguuguguguuucuucugauugauucugaaaccagagggaaaacauucucuuguuuucaucagcauagucacuuuucagcuuugcagguggccuacuccuuuccugccaagcacaaugggaaauggauuuccagaguagacaauuccauuagaacauaaauaaugacgauguaaaggcaagcucuuuaagaucuugguaggcagauucuaaucugcaaaaaccagaaagcaaaauaaaggaaaaagagcaccaccacauugaaaauuacgcauaacaucguacccagcuuacuccgugcacaaagauguggcuucuugucacuccucccauuuugagguuuucucugaaggccaaaacucaacuauggaucaucuuguauaacaugaaaggcggcuccagguuaauaaauuuaugugauuaaaauuccuugucucuuuaggaggcacaagcaugcucuaaaacagcccuggaguugcuucagcguaauuaauuuaucccauccuccuauaacugcacgcuaaaauggauucaacagaaacgggaaaugucacgcggccagaaugagauuuuuaugcuauuuuaaaacacucuggagcaacuacuuaaacaugcugcagccauugugauaaaucaaaucccugaagacuucuuaaaugauuaucugaaaagcacuuagaaaaaucuuuaagugcuauaucauagccucaauauuccggucaucuuuacaaggcauauuuaaaacuaauuucucaguuuaagacuuucugugauuuaacgaauaaaccucauuugggcucuauguaguuaaugaagugaaagaggacugcaagguguuacuuuaucgacuuauagaacuuguaacguggaaaagaccaccaaauucauacagccauuguccuccuuucauagaugaagugagaaccagcugacaagagcuuacaaaacuuguugaaagagggucacacagcuagaaagaaacagagacgagcucaagcucaggccuguggacucaguccaggauuuuuuucauacuuaacuaugccugcauuuaacugaguucuuaggccauggggccggguauggaaagaaagaauagacaguaaggugcaauguuuagggagcuggccuuuuacaaugagggagauucucucuuuuuuuuuuuuuaauuuugagacagagucuugcucuaucacccaggcuggagugaacuggcacaaucauggcucacugcagccucaaauuccugaacucaaguaauccuccugccucagccuccugaguaguuaggacuacaggcaugugccaccaugccuggcaaauuuuuaaaauuuuuauacagaugaggggcuguguugcccaggcuggucucaaacuccuggccucaagcaauccuucugccuuggccuucccaagugcuggaauuacaagcaugauccaucaaacauggccagacccugauuuaaauacaguauucucugccuccucccagcuuaaauuuaggugaucuuauuuaaccuccucauuugcaaaauaggaacaguugugacaauuaacugauccaaccuuuguaaagaauguagggcaguaucuagggcagagucagaauaaauaaauuauaacuauuuuuaaaugccuuaugcuuuuguauugaguacccacccugugcugaguauuaugugaucugauuuuuauauacuaauacauuucauuuuuaauuaugggauauggucaaagugaucaaaaguaauugcuagcaagcauuuggccauuuccauaaaaauauaggcaauauuuuucugcagcuuugaacauaaguguuagccuaacagacaauucuaucaugauaugucuugguguaagaaguuguuuaauauuaaaaagaaauauagaaauagaaaacaaaaaccuaggcacaugauuuuguccuuauauuagacaacuauaaagagcauaccaucauuugcuucugcaucauuuaucaaguccugacuacaaauaguuacaaugguguugcuuggaagaguauuagaaucacuuggagagcucuguuaaacuauauacauauacagauuccugaggaccuccacccacuuucucaauaagaauaugagauauggaagauucagaaaucaguauuuuuaaaaacacaccuggugauucugauaaccagcugagccgugauauuacuggugggaaaauacaccaccaauuagauucaauuauucuucuggggccaugauuuuccuccuaacuccaugagcuaaguuguguuagaguuagcagacaauucuuucucaaauagacucagguuuuagaaaaguucuagaacaccuuagcauaucacuaauaauuuucuuggagaguuuauaggaauuucacuaggaucccuuauggggugauaguuuaacaaacaaggaaccagaaaaaaugaaaaaugucaaaggauuaagacuaugggaacuuaaucugacucugccauuaccagcauggggacuugagcaagaguugcuaccgugaauggggcccucuuccuccccugguuacucaucugugaaauaauuggauuaggcagcagguuucaacucacgugucaguucuaacccgauugagaacaaaugccugaagaaggacauugggaaggucccugaggcauaggagggcucaaugaaaaacagggcuuccgucaguuaaaacuauuuaccacuuacaugggacaaaggaugucccugugugccuggcauuggccauuccagagccagauagcagucaacaaaaaaaaacugguaaaucuaugaaucagccaagaaucauucauuuuucaagaaauaaagucuguucugggaaaaacaccuuuauaugaaacagaaaccucacacugcuucucggaugagacaaugaaaauggcuacacugagugaugugaauagaaccaaaugcuuaaacugaagcaagaaagaaauccauaacuugaaauagggagaaaaaacagcauuacugcaacagagugaaauaagaacagagacagaacaauuaauucaguugucuugggagagccuaucaucuacuuguuuuauuuauggcuucaugcagaguuaaaguaaacaguauccugauuuauuuuucaucuuguuuuaaaugauaaaacugcacugaaugaaaauacuuuagugauuaauuauucuauuaggcaucucuaaauuacaauauguuguuuccaugaacaaugcccuauuauaaugagagcucucaauccuacagauaugagagagguuuuaauuuaaaucucaggggcaucauucaugcacuuuaccagcagagcuauugaauuagguaaucuaugucuuucuugggaaaauauugagauuguaaaauguuguaauggaugaaaaccagauccaugaacuauacuucacaaauguaaaguaauaugaugauuuuaacaacucaacuuaagacauggcugcauucaaaguaucaggagguuaaauaacuacccuccugcuuaaaccaggagauacuaaaacaacaucauuguuuuaauacuguuauuaaaacaauaaccugguauaaguugcaaaugcaucaccagccuccuuaucauuauauucagucacugggccugauuacaucugugagucccaaucagagauuauuuugucccauauaggacauuuggcaaugucuggagacauuuuugguugucacaguuugguggguggugggaagaagagugcauccuacugguacuaguaggucaagggcagggaugcugcuagacaucuuaccauguacaggacaaaucuccaaaacaaagaauuugccagcccaugucaauagugcugacauugaaaagcucuauuuuagccugcgauauucgaagcagcaccuaacacgugaugggcaaagugucuccaaacucugcuuuauauuuuggggaaaaaauagaauuuuuaucuaacucagacugcugacucaaaugaaguaccauucaucuuuuuuaaaauguccuuuugcucuagugucauuauuucucaauucaccaaauaguuacgcaaugcuaaugacaugucagacccucuucuaaagcacuucacaaauguuaacucaguugacauagguacuaucguuaucccguuuuuauaagugaggaaucuggagcaggaagacuaaguugucuguggucauagaucagaaguguuagggucaggaugcagaaauggucugucaaacuucagagucuauguucucauccucugcacuaugcuaccaacuuaaauuauguuguaaauuaaaucuguuuuccaaguuuccaucacauucuucucacuccaucacauucuucaaaagucaguuucgucaguaaaggcucugccucuccacccugcuucggugggcugacccucugugaccccguccuccuggugagcuugggaugaggaugaugaaaaccacacagaucccagaaccuuuuggugaaugcccacugaauguuccccagucugucaggcauucuaaagaugcaauuucuaauccuccuccaaccuuccaagguuaucuucuacauuuuuuuauacauaaacccaagucaaaugacuuuuacaaagccacagaguuuagaaguggcagacacaggguuuagagucuuucuaucuaucgccaaaaucugggcucugucuacaucauucugccaacuggaaaaucuacaucucacacauguuucaugugggaguuagagcauauaaaaguaacauaaaaccaccuucaugugcacagagcacaaacugcaguucagacuccaguaugaccagaccaaagagugcccacaggugaccacaggccaauugcaauccacagcugauuugacuaguugucacagugggacuuucuguguuugaagaaaauugaauuugcugucaauauuuuuaaaauugggaaauuucacaucagcauuuuuccguauuucugguuucucuugaaaagucaggcagaucugucaacacguguugauguacauuccugcaaggcaaaucagcauacuuucugcaguucaccaguuugagagacacucacaagguuugccggccaaacuuuucuguucuacgauagcacaaguauuuaauuauaugacuguagaacccuaguuuagaugaacagaguagcucagagucuuacuggaucaucacagucccguagagaaugacuccucugcuguguuuugguuucugcccaccauaccuucccucggugcacauggacuuuauaugcaaacaguaaaacucugguugauuguuacuaaccggagggaagaaaauggcacuuuaaaacaguguuuucucacacuagggccugucgcaugguggggagcaaggggagggagagcuuuacaacaaauaccuaaugcacguggggcuuaaagcuuagaugauggguugauaggugcagcaaaccaccauggcgcuauauaccuauauaacaaaccugcacauucugcacauguaucuuggaacuuaaaguaaaauaauaaugaaaaaagaaauaccaaaaaaaaaaaaauaaaacaguguguucuguuggugggaauguaaaucagcacggugguuccucaaaaaacuaaaagccaucccaaaaaaaucccaaaaggaaggaauaccccaaagaagggaaaucaguguauagagauaucuguauucccauguucaauucagcauuauucacaauaaccaagacauggaaguaaccuaagagucccucaguggaugaauaaguaaagaaaauauggcacauauccauaauugaacagugugccauguuuucuuuauccauucauccuacuaaugcugcuagauaguauaguacagauacuauauauuaauaguauauauuaauaguauaauauaguauacuauuauacuauauuauauauaguauauuaguauauuaauaguauaauauauaguguccuauauacuaaauauaaauacuguaauauauagugucauauauacuauauauaauauagugucauauaugcuauauauaauauacagugcaauauaugcuauauauaauauacagugcaauauaugcuauauauaauauacagugcuauauaugcuauauauaauauacaguguuauauauuauauauaauauauaguguuauauauuauauauaauauauaguguuauauauuauauauaauauacaguguuauauauuauauauaauauauaguguuauauauuacauauaauauacaguguuauauauuauauauaauauauaguguuauauauuacauauaauauauaguguuauauauuauauauaauauauaguauauaugcuauauauaauauaaaguauaaauaauacuacauauauuauacuauuauauauacuacauauuuauauuauauauaguauauauauuauauauauacuguauauuauaguauauauuauauaguauauauacuguauauuauaguauauauuauauaguauauauacuguauauuauaguauauauuauauaguauauauacuguauauuauaguauauauuauauaguauauauacuggauauuauaguauauauuauauaguaguauauauaguauauauuauaguauauaguauauauauacuacuauaguauauaguauauauacuauaguauauaguguauauacacuauauacuguauauagugcauauacuauaguauauauauauaguauauauauacuguauacuauaguauacuacuauauacuauaguauauauacuguauacuauaguauacaguauauauacuauaguauacaguaaauauacuauauacuauaguauacaguauauauacuauauacuauaguauacaguauauauaauauacuauaauguacaguauaugcacuauauauuauaauauacaguauauauacuguacauuauaguauauaguauauauacuguauuuuauaguauauaguaguauauauacuguauauuauaguauauaguaguauauauacuguauauuaauaguauauaguaguauauauacuauauauuaauaguaauuauauauaauguaguauaauaguauuauuugaauuaaugguauucagccuauuaugauaguauuaauccuacuuaauacuaugaauccuauuuaauacuauucagccauuauaaaaaugaaauccuguuauuugcagcaacaugaauggaacuggaggacaucauauuaagugaaauaagccaaauggagaaagacaaauauuguaucuucucccaugugagagcuaaaaaaaaaaaaaaaaauugaacucacagagcuagagcuagagagugcauugacagagcugggaaggguaguggggagggagaaugguaaugucagcaugguuaauggguacaaaaauauaguuagaaugaguaagaucuaguauucaguagcacaaauagggugacuauaguuaacaauucauuguauaucuuaaaauaacuaaaacaguggaaugggccuaauaaagaaaugacauuggaauuuuuuuaauaaagaaacaauaaaggcuugaagugauggauaccucauuaugcugauuugaucauuccacauuguauaguuguaucaacacaucacauguaccccauaaauauguauaaccauuauguagccauaauaauuaaaaauaaaaaaauaaacuuaaaguaugaacaagaaaaaccagcguguuacaggcugaagguuaaggccuugcaaagacuaacuuucugcuggaggcuuacuugggguuauugcagugucucuccuggaacuugacuccuccaccacauguccgggaacauucugaccacuucgaccaggcggaccacuggccguggaugggccggggcccgagcuccccaaacuuuacgcacuggccuugccgacaccacugugaaaagaacguguaagaugguucccgucagagaccaccugggaaagcgcagggaguugccaacaccugcacaguaacaggaaaaacaggucuguugggagaaaaggaaaaugccugauaccuugauaaauuccucugcugugcucuaaaaacacucaacuacucugcauugaccacauccauuuugaaaggcugacaucuagagagaaguggcauuguucaccaacaggcugaguaugauaggcuuugugaacuguggaggugacauguucagauaagauuccaccuaacagccaagggagucaguauaaaguuacaaggaagccugccuugccacugagagacaacacuacuuaaagaacaauucggaucacucauucaggaagaaacaguuaagauauuaacacaauuuaucauucugaaagaacaauugggaucacucauucaugaaguaacaguuaagauauuaacacgauuuaucauucugaaugauuaucuuaucauaaaauagauacaauuacacauacauuauauuuuugcuuauuccaaacccgucacuauagagcauuucuuacaaagcugaacaacucagucuguacaaauuguucucuucagauagcauccuuuuuccuuugucuacauaaaaggugcccacuucagaugcucugaugacuuugagcucuugcagugucuuugaugaauuagcccagggucuuucauuugcccaugaucuguacaagcuagauggagagcuuuuuucuguauuaaccuuuccauuuuaguucuccuuuuuguaacaaauuccuggcuuugcuggucaucucucccuaggggaugcauuagccucugguaguguuucuuuuguuuuuguuuuauuuuuuguuuuuguugccuacccccaauccccaaccccugcagugcuuugauuaugagaaaguucugcaugacuuagcauaacugcucuuuucuaaaagccucugcaauuagauccaaaggguugggguuuggaccaugccagguuuugcugaggaauugggggaucgguuacagaauuaugggaagguuguuugacuuucaaaucuucacuuauccccugcgauacauuuggcuucaugacuguuuacuguguggcuugguugcuagcgcacucuaucuagguuaagauauugcuuccuuucuucaaauucuugccaugugcugauuaauucuucuguuuuuaauuuuucuuuucccuggauuaauugccauuucagaguuugcaugaaaccauauaacacuauugagaaguuuuuggggaaggcuaucggucauuugaggauuuugccuaccauaagcaugcaucuuuucuaccgggaaucacgaggacucuacuggacugaguucaguggcugagacaaaauuacaauagccaauaacaguaacagcagcagcagccacagguuaucaagcugcuucuaugugccaaaaaugaugcagagagcuucacaugcaguaucucaucuaauccuugcaaagcacugaauuaaaagccguuuuccucaguaggagaaauuuagcaaagaaauacuagcuaacuugcucagagugacacaaacuacccaaacagaucuauucaaauaacuaugcaaguauaagagacuggauuuaacucaguagccagaacuccuaagcaggacacuucuacuucucaucuuggaggcaaauuacugaccaauguaccuuaauucuaaucuaauuucuuuuuggaaaauguguuuuuuagaucucuuccagucauucaauuaacuugauguucuauuacuucaguauuuguucuaguauuacguuaggcugcuaucacacugucuccauuuggccuuuuaaucaguguagaaaucaggaauauaaaggaauguacacacagaccugcacacauucacaugaauagguaaaauucuacauagaaaaugcaaauuuagaauauauacaccuguaauuuuauccaucuuuucuuuucuuuucuuuuuuuuuuuuuugacaaaguuucacucuuguugcccaugcuggaaugcaguggugcgaucucggcucacugcaaccuccgccucccagguucaagcgauucuccugccucagccuuccaaguagcugggauuauaggcgccugccacuacacccagcuaauuuuuguauuuuuagcagagacaggguuucaccacguuggccaggcuggucuugaacuccugacaucaggcgauccacccaccuuggccuccgaaagugcugggauuauaggcgugagccaccgcgccuggcuccaucuuuucauacauacauauuuuucuuuguuguuguuguuguuguuuuuagacagguuaucacccugucacccaggcugaagugcaguggcacgaucuuggcacacuguagccuccaccucccggauuuaaguaauucuugggccucagcuuccggaguagcugggauuacuggcgugcaccagcaugcucagguaauuuuuuguauuuuuaguagagauggaauuucaccauguugaccaguguagucucgaacuccuggccuaaagugauaugcccgccgaggccccccaaagugcugagauuacaggcaugagccaccacguccaggcccagcauacauauuucuggcacuacaucuaauuuccaauugaauggccaugacuuaggccauuaucuuuuuauagacagcauguacaaaccuuucuuuccgugcacacauauuucuagauaaaaguaaguggcuuggccgggcgcgguggcucaggccuguaaucccagcacuuugggaggccaaggcggauggaucacauggucaggagaccgagagcauccuggcuaauacggugaaaccucaucucuaauaaaaaauagaaaaaauuagccgggcgugguggcgggcaccuguaguuccagcuacucgggaggcugaggcaggagaauggcgugaacccgggagauggagccugcagugagccaagaucaugccacugcacuccagccugggcgacagagcaagacuccaucucaaaaaaaaaaaaaaaaaaguaagugacuuucauacugccucauguuggcugaguauucacaguacaaauaucgcugaaggacaagggacuggagaagaaagaggaaggacagaguuggguuccaguuacagagaaacaaacaaaacauugaguaccugcuacugugugucagacacuccagaugaaacaaguaaaaccagggcacuggcccucaugaaauuuacagucuaacaagcagccagugauauccccuggugaaggaagaaucugaggaaaccguauaugaauguaauaaucauuacacgggagugaugauggauggaacuuauuaagaugcuuucuguugagggugacauuacacuuaagggcuuuucaccaguauauaacuauagccugguguuuuaaaauaacgugguguggcaguuguaucaagacauuuguuuucccacuucugacuuuauuuaucucguguucuguuuacugaagccuaacacaaguacguuuuaucccccuuggaacuuagauaccugaagugcuuauguaauaaaucuuuagaccuaggugauguaucacuuauuuuucucauucauuauauaaauauuuuccuguguaucccuuauagguaacgauguugcuuuuucaauuaaaaaaaaaaacaaaacacuaauccucaagucacaaguucuaaguugugaugccucaaaaguaaaaaggacuugagcacuauuuauauuuuaaauuauuccacuaauucauuguuuuguaucaucauggccccaacauuucuauuaacauuuucaagaacaguccucauugggaaucccuaagaccacuaucggauuaaaaauugcacauaacuccucaauuuuuaaaauguucauuuucuuuaaaacaaagaguuaaaaauuacaagucuuuuuaagagauagugaauaaauguccuaacaaauaucagaaaucugugccuuugccucugauguuggccucucucugaaaaguccuuuuuaucaucuaacugaagaacuuuaacccacaacccaacaaccaucuugaugcauguacuuguugugguuuauucuaagugcauagcuaaucucaagcaagauucagcucucauuucaucugggccccgacagcaacuacugcuuagagaaggugucuuuaaagagagaauuaguuauuuccuucuguauauguuuccccugcuagacuguaaauuuuuauauuuuuaauuuauuuuugagagagucuugcucugucacccaggcuggaauucaguggcacaaucuccacuuccugcaaccucugccuccaggaugcaagugauucucauaccucagccucccaaguagcugggauuucaggugugugccaccacgcccagcaaauuuuuguauuuuuaguagucccaagguuucaccacguuggccaggcuagucuugaacuucugaccucaagggauccacccaccuuggccucucaaagugaugggauuacaggcaugagccacugugccccgccuggacuguaaauuuuuaaagaaauacaacucugguuuauuuaucucuacauccccagagucuccuguuccccauaucuaguaaugaauaaauuauuguggaaugaaauaacuuuuucuuuuuuagagacagggccuagcucuguggcccaggauggagugcaguggcauaaucacagcacacuacagccucaaacuccuggguugaagcgauccuccuccuucaaccucccaaagugcugggacuacaggcacgcaccaccaagccuguuuaagcuuuuguagagauagggucucgcuguguuaccuguucuugaacuccuggcuucaagcaauccucccugcucagccucccaaaguguugggauuacagguaugagcuaucacacccagccuugacauaacuuuaaaggaccaaugaccauuuuuuucuguauagguuuauacugccuugagacagagucaauaauuaagaucagcaaaccuguaacaucucauuaucucuugucauucauagcuccucuuugauuggccuuucaaaugaacuucccaaaucuggaucauuuacuaguagcccaaaugcaaccugcccucccuccagacucuauugagaaagaggaagaaaaauagaaauauaugagaguucuucauuaaaaauauugagaucuccuauaaucuuucaaaauggaggugguucucuggguaggagaugcucaccagcaaaaggaccuuagguacacacuagguggaggcgucucuuacccuucaauaggaaagucacuguacaugaugggaaucuauagggcaugucaaaagcucaaugacagcuccugugaguugagcugaguagccgaagccuuggucuggagggacagucauuucuugacuaacaagacaucugaucccugagacuuuuuaaauaccacaaguuuaaaaggaaaaugguaugcaaugaaaccuguaagcucauugaaauagagauauuuugagccaagccaccaucuaaaacaggaagacaaaaaagaaaaaaaaaaucuucuuaaacaauugagcuaccuggguuauauuagcauuaagcuuuguaauugcugcuauauaauguuguuaauaugaagagaagucagagaauauaaacuaccaaagcauucacccuaaggucacaauacaaacaguuugaauucuaugccuuaucaaauuucuggagcuaaaaacuaacaaguaugcaguuuaccauacucaagccacaaacggucccuucugcugcgggcauaaacuuggucucacaccuguggccuacucgguggcaccaaagugauuugcaaauauccugaaauaaaaaaaaaggggggugcuguuaauggugauauacaauaaaaacaaaaauauucaaagauguuguauauaauauuauauuuugggguagcugaaaucagagcaauuauucagaaaguagaggccagugaaguuggcaacaccaaaguuaauauguuuuaguaacuauauaagugggggguuucuacaguauccagauauucauguguguuuuguaacagcugguagguagcaacaguuaauuuagagaacacuuggcuuggaagugauagaucugguuucucaugauagugaugaugauaaccgucguagcagaauacaucaagauuggaauaaagcaagucggauucaagucuucauccugaaaugccugguuucaugcccuauggacauguuauggaaucccuuucaguugcaguuuucucaccuguacaauagcgaucaaaugagcacuugacucuauagacuuauucucaaggauaaaugaggaacuacauguaaagugaugguuuugccuggcacaugcaguucucaaaaauacugccuaucauuacuaccuuuuucaucuuuuuaaaaaauguucuacaguugcuuuuucaagguccuauaugugcuuaccugaagcauuuucuaugagugcuguuuauaguuuauugacugacugacuguagagacagauucuugcuuuguggcccagucucaucucaaacuccuaaccuaaagugauccucccaccucagucucccaaacuguugggauuacaagcaugagccaccaggccuggccaccuucuucgucucuauugcaguuuucaaauauguagacaauuuaacucucaaaccaggccuaugaaauaauuucauucucaugcuagacugugguacacagaauaauggcccccaaagauguucgcauacuaauccugggauccugugaauaugugaaguuguguagcaaaggagaauuaaaguuacagaugcaauugaggucaucaucaauugaaauggagaggcagagacuguccuaaauuuuccaggugggccuaacauagucacaagaguccuuauaugggaaagaggagcuuagaagagaaccagagagaugacagcuugagaaagaccuaggagaauguugcuggcuuugaagaugaaggaggggccaugagccaaggaaugcaggcagcuuccagaagcugaaaaaggcaugaaaaugacuucuccccuaaggccuucaaaacccugcuaaugcacugauuuuagaccuuacuuucuuuuuuuuuuuuuuugagagugaguuucacucuugucacccagccuggagugcaauggcaccaucucggcucacugcaacccccgccuccuggguucaagcaauuaucccugccucagccuccugaguaacugggauuacaagcacgcaccaccauguccggccacuuuuuguauuuuuaguagagacgugguuucaccacguuggccaggcuggucucgaacucccaaccucaggugaucugcccgccuuggccucccaaagugcuaggauugcucacaugagccaccuugccuggccugauuuuagcccuuucaaauaucuacuuccagaacuauaagauaauaaauguguguugccuuaagucacacuaaguuuguggaaauuuauuuagauagggaacuaauacuuuuacuaccauuuuagugguggaaacugaacuaauucuucaucuaaacucauuuagcugaaaaaacugagcaagcuucugaugcuguugaacuuuuaaaaucacacagcuggccaggaacaaaggcaggccucaagcuggccugauuucugagucuaguaacaaccacuacacuaggccuggauuugccacugauggauauuggaaggcucucaaauucuccaggccucaguuuucuagucuauaaagaaacagaaccagauuacuuuccguucuaacaguuaaaguugauauuuacaauuauagcacuaauggaauguugugaaacauugugaaaggucaaagugaccccauuuuggugggcacauucuauuuccaaagauaaaaaugugaagauggacauuuuggagaaaauauaagcaaccagagaggagaaaaauaauuuuugucauuacuuguuguaauccugaaaauucaaugaaccaggcaccuaauuccccaaacacuccauuucauguagauuuuacaguuagaaaauauggcaagaauaugcuuagaaauauuacacaaacacucaaaaaaaaaagcuuuccaugggacugagaaaacauagggaaaccagauguauauauauauauguauguauacauacauauauauguauguguguguguauauauauauauauauauauacacauacaguaauuuuggucuuguagaccauaaaauucuuccccuaaaaggagaauggaagaauauugaggacacuacuuagaaacaccaacaccaccagcugccccagaugugggcacguguaccauucccaaaucucaaaacagcuccuaagcuagaauauauacauauucccgugaaccugccacugacauuagcagaaagcaugaggcagccucccagcaaacugaaucacagucaucaucgcuacguguugucguauugagucacccucaguuugagggaaaucaaucaauguggguaagagagccgccuaugugaaaugggaggcaugagagauagcacugaaaugauuaaaccuacacuuagaaaggcuuucagaacuaaauuguuuuucuucuuacagccaggaaaaagccauaacccacacccagugccuauguggcagccaccaaaauggcccuagggcagaccaaagaaaaggagggcuagcugucguagccaaugccaagccacagaaccaagagaaggggcagcuggagagaaccaggaaaacaaagcaaaacaaaaaaaaaaacacagggauuccagagugaaauaagacaggcugcaugaacauguuauuucuucugcgguggaguacagaagucaaggguaauuauagccaacuacauacucugacgaccaugaaagccccuugagaaggcucccuuucaaaggaaacgcaaaucagaguuugcacuuuuuuugcuuguaccuccccccucuuuuuaccagcauauucaaauaacuuucccuuaucuauaauucccuggacuuaagucauaauuuaagggaaaaaaagaaauaaccacagagacuccaaggucucauguugccugcauaugauuuuuuuaaacuaggcaacauuuuaaaggaaagagucccaaugcuauccauuauucuguccugucacuugcuguguccuccaguuguauucuauaggcuggauaccccuucaaguaaaaccugacaugcugaaaauguuaauggcuuuugcaaaccaaauuuuaugaagcauuacaaacugaacacauccaaaauaaaaguucuucauuggcuccuccaaaccugucccauguuucacuguccccaucucacucuaagacaccucuauauucccauugguucugguaaaaaauccuagagucaucuuugacucuucuguuucuuucacauucuaucaagaaaacccccaccagaucaugaaaucauauuggcuuugccuucaaaauauuuccagaaucugaacaauuauggccaccuuccauuucuacuacccuguuccaagccacccgacauggagcucacugccagauccuccucacaagccucaaaggcuuuuacccgcacccuugcccaguuuauucucaacacagugacuagagcuguauuauccaauaugauaguuacuuucuacauguggcuuguuaaaccugaauuuacauuacuuaaaaucaaaauaagaauucacuuccucaggcacacuggucacauuucagguucauguguaguaaguaccuaccauauuggauaacagagaacauuugcaucauuauggagaguucugcuggauggcacucaguuagggagagccuuccaaaucaacucagugucagucagcucauggcacuuuucugcucaaaacccuguuaugucuugucaauucaucacgagaaaaauccaaaguccuaacugucauccacaaagucauaugcacucaagcccccuguaucucccugacacuguauccuaccaguuuaggucuugcucacucugguuuagccacacuggcucccugaugcucugccaacacucaaauuuugcucccaaagcgggucuuuacacuggcuguuccacuucuucaacuaucugcaucucucucuuaccuccuucaagucuuugccuaaauuucaccuccugugaccucgauauuaaaaaauuuaaucagccaccaaccagucagucuuccaauuuuccuuaucuuauuccaaacuuacuuagcacuuguggcuucauuuacaacaucauugacuuauuuauaacguuuauuguguuuuguuuucucccccacuagccacgagaguacagaacuguguuuucucucugauguaucccaagcacccaaaacagugccugguacaaaguaggcuucaguaaaucaauauaugaauaaaaaugacagacuuuguauuuuaaaauagucuucauuuguaauaaagacucuggaauuuuuaagagcuuucaagaauuaaaaaaaauaauaacaugaaagaaccuggcaaacaguauaugcuaaaaaaaacuggauaaugaguuuugcauaaauuauuucauuguaucaucauuguggccacaugacgaaaguaugacuaucuccucaacaugcucaugagaaaauugagacucagagaaauuaagaaacuucuuccaacuucuuuuagcaguuaagucucuaguuggccuggauuuaagcccauguaugccugaguuuauugcccaaguuuuuaagcuaagcaauaauuuaaaaguaacaaauaacaauuaacaaguaggagucaccaagaauugccccgaugccauuuuaaaaaucaacuuuacagagguaugauuuauacaauaauaugcauucauuuuaaguguacuguuccaugcauuuuggcagauauauacaccacuauaaacaccaccacauucaaggcagaauauuuccaucacuccaaaaaguuccccuguccccuuuugcagucaauucccuucuuagggcaaccaccauucugauuucggucaccaauaggugaguguugccuauucucuuaaauuucauauaaauggaaccauacagaauguacucuuuuguucggcauguuuuucagucauccauguuuuuguguguaucaauaguucauucuucuuuauugaugaauggaguuccauuguaugaauacagcaaaaucuaaucugcuugcacauucaccuuuugcaggacguuuaaauaguaucuagucuuuggcuucuaugaaucaaauaguagcugagaauguucuuggacaagccuuuuuaugaacacaguccuuuauuuauuucagguagauaccauggaguacauuugcugggucaaaggguaaagguagguuuaacuuucuacauugaaacaacucggucaaaccauuuccaaaaugauuauaccacuugacacacucaucagcaauaugcagaguuccaguugcuucuggucuucgguaucauuugguauugucaaucuuuuuaauauucuccauuccagucagugugcaguggugccccauuauaauuucuuuuauauauuccugagagcaauugauauugaguaccauuucaugcauuuauugacuauguguaugucuccuucucugauauauuauuugauauauuccugagagcaauugauauugaguaccauuucaugcauuuauugacuauguguaugucuccuucugugauauauuaauuuaguauuuugcuccuccccuccuuuuuugguaaggggauuggcacugguaccauuuuauauuuuuucuagguagauaauaugagaggcaguauaguauaaugguuaauagaaugugcuacccagauccaauuuuaauucugccauuugcucauauaaagcuuaguaaaacauuuauuuuuauguacuuuagauuucuuaucuagaaaauguuaauaauagcacaucccccaaagauauggaaguauuaauauguaucgugugcuuaaaguacuaucugauacauaauaagcacugaauaaauauuaguuauuauuauaggauggaaagaguaucuuacccucaauuuucuaagaguucauucacauauagauaucacuacaauuuugacucuaaaaccagggccuuuuguuuuccuguauacuagcacuuucugacuaaucuugcucagauuauuuaacuucaauuuccuuucugcuggauucaggggggacaauaaauaauguuccugucucuuccaccacuagauaaauaagacacuggaguccaagaaauggaaaucuagauaauaaccuuauuacugauaaucaugaauuggggaauguggcugagaucuguggccaaauaggucuuccaacacuaucuccacugcauuagaccaacuaucccuucacacuugcagguagaggaggcaaacacaagucucccauccgaggcaggcaaccuccaggguggcagaagagaagugugcauccugcagacaggcagcacaagagagaagaugcugagacaguacuguggcaugccugcucagauauagucuuaaacuggucaaucagguaagucacuccugcugcuuugaggagggaugagagaagaggcagaggggacaucuuccacuuuauggaagugggagugcuaaaacaugugagcuuugguuaucacuguaagcccaauaaauaacacugaguaucugauaugacauccagcacaugcuaggcauggcagauacucucuaccaauagaggcaagagauguguauacacaguuaaaauguaucacaaguuuauaaaagggacacauaagcuggaauuggagcccagagaaauaaauguuuaaaucucccugaggaaauaaggagguaacacuugaauugaaucuuuaacaacaauaaaaaaaugauuaagugucacuggguggccacacagcauacuagaauaacaaacauauacaaaggcuuguagacacggaaaaggaaauauuuggaaaacacacaagaagaucaacaucacuggagcguaagugcaugggggaaaguuaauagaaguuaaaauggcaugcaguaaacuugguauguuacaaaguaauaguauaauaguaucaaauaguaugauuccaugcuaggaaguuucuaauuauucuccauucauuaauccugaugucaaauucuuaaagaagugugaaaggaaguuaaauguuggaaccccaaacucauuaagccaaauagaaaagucaagcugggaacucggucacacaaaccugucucccccuuucgguuccuaaauaagauggcuacaagaugaaaaacuacacaccucccccauauuuugcccacaaggagauuccuagugagcuguuaaaauuucaccauggcaauggaaauugauagcuuaucuuuacaggugcagucaccccagcccaccagacacaaaugcauaucugauuguuccccugccccacugugucuauauuuaucuuauguaaaaugcaguuucacugcauuuuuccucugccccauuuguuuaugucaucuuauguaaaaaaaaaaaaaaaaaaaaaaaagccgguucacugagccagacaaagucaugaauaacuauuguucccuacccugcucuuacaugaaaaucguguacuucucaauuucccgccauuuccccuuuaaaguuggagcccucaaaaucaucuucaggaaaaggcauagaccugucucccgggugcauccuuaacuuuggcagauacauauccuaaaaugcuugagacuugucucgucauuuuucuugauugacagaagaaauauacaccgauccugcuauccuuccaauacaaugcucucuagaaugauaggccugagaacauucacaagaauuuaaauaucuuccccacgauuucuacucagcuucaaacucucagugggucuaugaauaaacauuaaaacugagcuccugcuaugugacaguaacugugcuggcuacugagguacagggucagcuaaagaggaugcauuuguucagcugcucacuucuagcuuaguaaaauaaccagcacagaagucucgaucagucugugacagcgcuugggacccucugacaaacagcaucagcucacucauggagucaguaagcauuucuaaagugcagaauaaucaaaugggcgcucucuccacuuguuacagagggaauccugcuuugagucuuuccagauaacagaaccauuagaaagauucguaacucauuuucuucaacacuuuggaugagaacagagaucaagucuggcaugcugaagacacagaaaacucgugguugggaaaggaggggaggauggggaugagugauccaaaagagccagccccagagccuuuaccagggcagccacuggggaagaagagucaaaugugaugguggugaugaugcugaagacauaaggaagagaguuagaagaaaccguauuguuuaucaagugaugcgacuguaccaagagaugaauccucaccaaugagccauggaggaacuauuguaaucuucaccuuucaaaggugaacucuaaggcuaagggagguugagucauuuccccaagcuuauaggaaaucucggaacaaaauuuuaaagcuaggucuuugugacucccaaauccagagauuugugugugcaaauguguaugugugaacguucaaaauugaagacugucuaacucagcgacccucaaucuugacugagcaucagggucaucuagagcuuuuguuagaauauggguuucuggguccuagccccaaaauuucucauuccuuaggccugggacgagacauuucucacaaguuucaggucuugccgauacacugcaucugcuggucugagaggacacuuugauaauuaguuccuuuucguuguuguucuucuaaucacuaugcaacccuuucacuaugcaaugcuuucuaggaggcauggaggaaaaaaaaaaguaaagugaggggaaaagauuagaaaguaauaaugggacaauaaaagcccugaagacaaacuucaccucuuuccugcguugccagagcgggucuaaacuguuucuacuagacaggaugaauaagagauuuuguugcuuuggaaaucccuccuggcuagagccuggcaauauuuaugauccucagagguguggccauggguucaaguuauaaguagguuuaaaaacaauaccaaaagcuaagguguggggaaaacaagcuucagaaucuaucaaaccacccuaccuucuccauuaaccucaucaccaucuuaaaucauuucucucuuaagcaagucuuucucaccuucccuguccuuguuugacucaaucuuuuauuuuggaauuuucauuucucuuugcucugcuucccaugaaagaccaucagaaugagaagcugucuuuuaaaaauauagugaggucccagaaagcaaucuauaauuuaaaaagguuguuuaagcccugcacacugccugacacagaccagguaccccacaaauacaugguucugaaggaaugauaguaauuuuaggaaccuccuuuguauuucugaagaaaauuauacuuauuaccaacugugcuuuugcugcauaguauguaauaaauuugugauuaauaaauaacauaaugaauccuuuagaaugaagugaacaagaggcaaauuagaauacaaacuuuuucaacaaagugaauggcuacuuaacuucugccaaaaccaucaacuuaacaggaaaauagaacagucuguuaauuuuuuuuuucuuagaaauagggucucagucuguugccugacuguacugacuggaguacaguagugcuaucauccuucacuucagccucaaacuccugggcucaagugaucccccugccucagccucccuaguaguuggaacuacagguacgugccacuagcccagcuaacuuuuuuauuuuuuguaaagagagggucuaacuuuguugcccagguuguucucaaacugcuggccucaagugauccucccaccuuggccuccccaaaucuugacauuauaaguauaagccacuacacccagccaauuuguuaguuuuuacagaaggcucaccagcauuucugaaaguaagcuccaugugucaugaaggauacaccaaaaaaaugugaaugacauccggaaaauuuuuuaauaguuaugcauugaaacuguaauagaaaaaaaauguaaucccaucucaaaccuaugauuugaugaauauuauuucuucggacuggaguuauguuuugaaugugaauugguuucuagaaaagcaauaaaugaauaauaauauagagauaacacaacuaaaauaaagaagguaguuauuaaugacugaauauuaaugacugaaguuuaggaaacacuaguaauagugacugguaccagucaccggugaagaagaggaaauuucacaucaaugugugugacuuguuuuguuaaauuccaccauuuaaaaguuuguggcuuugggcaaguugaaaauauuuucugagcuccaggucaaaagcgguaauaauucuuccuugaaggguuuuugugaagauugagguaaaguaaaauaaaucuuuaaguagaaugccuuauguggggcacaggcucacuuagcaacugcugaagaugauaguaaauggugauagugauggugauggugguggugguggcagagaaggaggaauagggagagaaagaggaggaagaagaggaacaggaguagagggggaaagaggagcuauaaaccuccauaauuuccaugcauuuuucaguuacuuagaacuuccauauuucucuuuggauauugggaauaaaccaacuuaaaaaugauucuacuuuuuaguaugggccgggcgggguggcucaugccuguaaucccagcacuugggaggccgaggugggagaucacgaggucaggagaucaagaccacggugaaaucccuucucuacugaaaaaaacacaaaaaauuagccgagcaugguggcuacucaggaggcugaggcgggagaauggcaugaaccugggaggcggagcuugcagugagccaagaucgugccacugcccucaagccugggcaacacagugagacucugucucaaaacaacaacaacgacaacaacaacaacaaauuuacuuucugguaaaguugagauuguaauacugucaguaaaaugucauucuugaccaaguguaacaacgugucucucauuucuauaaccuggacuuuuguacuuucccaauuaucuuuuuuauaauucuuugaagaaaagaugacacaaaaaucuuauuaauauuacuaaagauguaccuugaauuuauagacaauauuaaaaaagcuagcugcuaauaguuaucccauauuauaaaaggcauauaauguauuuggguauggugaugauuugaaacgaauuaaauuaacagggaauaggaucauauagagaacaaaagcagugauuagcagcagguacaaacuauuguucccagguuuacuaguagggauaaagucuucauuuaaagagaaagaauuuucuaccaagcaguauuuaaaccaggcauggucuauguggauaggccuggauaauucauugacaguaaaauugccacuuaauuaucaugccaaacaacugacacgguagagauaacccagaaccuaacccuuggccuuggcaaaccaaauguuuacacuucuguuagggacacagacacauugcagagucuuaauguaaguuugaaaucacaagcaaacauaccuucacaaaaccaaggcugcauaacuuggcuuuugcuccaaauugccauuuacacugugugucagcaucauaaaucuguccugguaguuuguccggauauuuauacuguccugcuugcuugggcucauccacuagacaccccgccugaggugugcuguaaugacaauacaugcuuauuaauuacucuguugaucugugaucuuuccauuuacgacaacacacuucugaaugcauucaugcaaagaaaaauauagcaugguucuagaaacagguauauguuuaaaguucaaaucuauguuuaugccaaagagugaguccugucuaagaggauggaauguacacagccaggaaggguuuuacaggaugcugaaaauucuagucauccaagugauuuggcuugggauuugacaggagacaggaaagguuaauacauuugaaaacucccaucaacaaucuuauucaacaauauuugacaauuuguacugagucccuacucuguggcaaaccuuagacaaagcacuaaagguacaaaauaaaccagacagacacaguaccugucuucauggaguuuuaaaucaaguauuuucuuuuuuuaaacagauaauggagcagaggucaaagauguacuuuaacucacaauaagccuuacagacaaaaauaaauaacauuccuaaagaaucaagaggaauaaugaacugggggaugaggcagaaaaauuuccuucagauauguuugacugugacuuguugagagcaaaaaucaguccugauggcauggauauucuuagcaccuuaucuccacuuacuuaaauaauuaaaaugugguaccaccgagaaguuaauuaucauggugguuaaguguaauuuuguagugagacagauggggguccuaaucaaccaugcaaccaagaccaaguuauguagcucuuacacagcucaugagugacaaugacucucauaaagguuguuacacaguucaaaugagaaaauauaacaugcuucauaaagcauaauaagcaaaguuagcugcugcuguuaucauuauuauaacauuuaacuacaaaagcauuuaacuacauacuaacggaaauucagccuauguuaaguugaucuugauuuuaauacuuauuaauugcauucuuacaugaguuggaaaaaauaauuuuagucaccaaaccaugaauuuaaaacuaauaggaaaaucuucauggcaaagcuuacuaacaaaaagucuguugauuuuuuaccacccuuugggcauaugugguuagauaucuucacguuuaauaugcuuuguguauagaucuuacuaauucuuuaaacauuugcaaauaauacacagugguacagguuaaaaauaaaguaucaaaagugucaauucccaaagaaauuucacuaacaucuguucaaagagauaugggauuagcaucuaaguguccuugugggucaauauagauuauaaagguaggauuguguguguguguguguguguguguguguguauuucaacuuuggguuaauuguuuaauaugaauuaaauaguacaacuuuccaaacuccuacuuuuacuaaugcaacuuaagguuucuguguuauuaaaagcauuuuauauagcuaccaucuucuuuggcuaucauuuggacauaaagcuagcuccuggccauuucaaacauaauagucaaagaagaaaaugcucuauucauuaaaacacaaacacacacucauaccauuugagcauuuuuaaaauacucuaugacacauugaucgauaacauugaaauaauuagucacaguaaaaagacaauauaccuagcagccucuggaagucacaggggagagaugguugaguagagauccuagagucagaacagaucuaagugugagucuucugucugcaacuuaccagcgauaguaccuuaugcaacacaauuaaccuaagacuugauuucucaacucuagauugaggauaauaguaucgcugugaggauugaaggaggaaauauguggagaacauuuagcacaacauuaggcuucaaucuauuuuuuucaacaaugucaucaucaccaucaucauuaucaucaucauuugucuuucuguuuauugacaggucaaaagguauuuccacugaguauucguuugcaggucuauggagcacaauucugucaucacuccaaaccuaggagcaccccaggauuuaaccugucauaccugaggaauuucuugagauacuggcggcugcaggaagaccaugaaaacacuccauuguuuccggucagugugggagacaugauauugccuucagccuuucugcagggauucccuucuccaucgugaaucauaccaaagcugaaacagaaugaagaaaacaaaauccugcuuugugaacccauuuuuuugaaggauaaucugaggaagaauaaagauguauugaucaucaacaaaaccaagugagagacagaguuauuaaaacuggaaaagagaaaggcaaauuacuauagauuguuauaaaauucacacagaaaacuuuaaaaaugcugagggcuuuguuauauuauuuccugaccacagaaucaaagaauggucuagcugcuacauguuuuaugggcuggaaaauuuugcucaaguuaaaauuuagguauaagcuaagccaaagugauggaacagccaaauuauuuaguuucaaacaguagaauucuuaucuugucaccaaccacggaacuaugguaaagaaguucagagucaguaggaaguaaguacagagagaugaugauuauaaguuguuuaugaacuguucauauauaaggcuagcaugguauaaaaacuucucuccaacuaugaucaauuuauuagcugaaaucacaaacucuaauuguaauuaaacucucuuauaauaaacauuuuuuuaacaugcuugaaccccuuuauugaaggcuauuaaaucuugaccauuacuguuaucuuucagauguauuauaugagaaaacuuuaauuuguuucaucacagaagggucuaguaauuauagaagaaaaacuuuagguggucuacugucuagaaaucaugcacauuauaccugaagaauucucaaauuuccugacaggaagaauaaaugugacauuaaugugcauacccacauaggauacauaccauaaagacaaagcuuacuucaggcgauguuaaagugguagaagauggggaaauaagagucuuugaucuucucuaaaaaauucagcacagagaaaagucuuuucugaaauuuuuuuuuuuuuuuuuuuuuuuagggaugcagaggacggaaggauauaaauaugaauuucaucauuaauuuaaauuguucuuaaucucauuauuuaaaagaauaaaacuugugucuuagaccauauauuuauaaggcagauaugacuccuauguaaauaaauguuauccugauauaauuucauuuauagaguucgccuuugaaaguagucuauaccaaauaaauauguuacgauaaaagauaugacuuuuuuugugacccaugucuauaauauggccauuuuuccagcauuccuuccacuuugucaggaaaauaguagcagggcaacuguaugcuauccuaucagugacuuccuuagguauucagaggugaccacucaaaaauagguauugacuaacgucaauguauacucagugaaagcauuuucuuauccucagcuuuucccaauuuaauucuucuucucaccuaaccaagacguuaaggggauuucuuugggagacacccuuucuaaauauauuugugaaaguaaaaaacagaaagaaaccuauaaauaaagcacgagaagaaacagcaagaaucccagaaacagagaugggguaggagagauugaagccauuacgcuagaggaaaagaacuuacuuagaacuucaguggaauuuuaugugcguaagaaaaucaagucggaauuuaauuuugaacuuaacaaucuuaaauuuaauuuaauagcauuuuagaagaugauaacauauuuucuuuagcacaugccaaaugccauauaaauaucucaggaauugucuguuucagaacuucuuaaguccauguuauuuagaacuuagguauguauuuuauuuuaccaucuguccuucccccaaccucugacuucucuccugaauccuaccugaagaauauguucugcuuuuccuuaucuaaaauguuggauuuugauuuuggauaauuuuaacacauaugcaaagauaaugaaauuuuucaaugaccaguauuuugaaaagugacaccuguucgguuggacuucaugcugguaaaacaaacuuagacauacauuugauaugcacacauauuuuguuuccugcuuuguaugagaagcauuguucuuagugagcauuuucgcuucuccauuuacaauuuuaaaaauuggcuuauucauaucuaggaaagugugcaugugugucuaaauguguguguguguguauaauaauguuggaaauuuguuggauaacaauaacaacaaugaucaagguuuaaauuuccuaaagauaauaaauguagcucauagaagauacuggcacuguccgggcgugguggcucacaccuguaaucucagcacuuugggaaaccgaggucggcagaucaccuguagucagcaugaccaacauggugaaaccucaucuguacuaaaacuauaaaaauuagccaggcaugguagugggcacugguaaucccagcuacucaggaggcagaggcaggagaaucacuugaacccgggaggcggagguugcagcgagccgagaucgugccacugcacuccagccggggcgacagacggagacucugucucaaaaaaagaaaaaagauagcagcaccaacauauaaaaauaccaacuaugguuacugaaugauguuugcuuuuaagucaaaaauuaacuagaugcuuugaaaauauaugaguuauuuccuguauguugaauaaaauauacacacaaguacacacacacaaacauccuaaacugguauaucugaagaguacuacacauugaaauaauuauuuuguaaaguauuauacuuguuccaaugcagcugcuauugcucuaauguuugaaaauucucuauagcguugucuccaucauaaaaggaagauuuagugacaccaaucaaaagaauauuaaguacaugcaauguugccaacuaaaagaauauucaguacaugcagcaaaaguuuuuuuaaaaagcagcaugccauuauacuuugggaauuaauuuuucuccaugauuacuuccugugcauaaagaaucagcuagaagugucuucauugcugcaaaacaugaacaaaaauaaacaaaugccuagcagcccagagaccccaucugugcacacgaaggaguacuguguggcuauuaagugcugcuguuuaaagagaaugaaaucaacaacagcuagccuuuagugagcccuuuguauagucagaaacuauucuaagcuuuacacaagacugauccucuuuguucugccuaagucaacaacaacgguuagaggaacaccaaugaaucacccaacuaguuuucacauaaaguagugguucaaagaggcacuuacuugugcccugacucaugagcgauggugaaggcaaggccaaguccuguguccucauugaugguacaacuucgguacuuagagcacauuccacugaugggggcaaacccuauugaaagagcaguuucaaaugugaauccaaagguugcacacacagauacaugaugaugauuuauguccucaaaauguucuacacaguuuuaguuuaauagaucaaugcauucaguguuuuuggaaaaaaaaaaaaaaaaagaucuauaguucuuuguccuguguaaugauaauguauaaaugcaacauuuccuauuuucuugcuuuuguuacauauuguuaucaauugauccuuguaagagcccuguaaggucaguaugaguacuguaauucccauuuuacauuuaguuuaguaagucacagaauauuuauaugccuugucugaguuuaucauucaggucagagcaacggauagaaugauagcaaaaccaaugcaaaaugcucacugaacaguggcauuaacgucacagcucaggguguauuuuccaaggaaaaacacauauccuggucuuuuacuagagcagaaaacaugaaaaugucuaagcaacaugugcagauuaaauucauuuuucucugguucuuuauaaugugguaagugcuucuguucccaaaguuacuucccucuaagagccauuauaaaagcaucccggccagcccuuaagucuaucuucaaauacaauacagugugugcgaacaucuuucuuuccaguuuuggguccuaauaaucaguagaacaaaucuauguacccaucuaauauuaaaugcaugcuugugaauggauuguacccacuucauugucaagacggaagugagaucagcugggaaaucuaauacaaaggcacaaauaaggggugggaucauuaucauuacuaccaucgucaucgucacuaaauaaaugguugcaaauucacacacugugcuauaugucuauuauauaucuguguguguauguauuuauagcuuaggaaaccaaagcucagagaggugaauuaacuuguucaagaucucagagucauaaauucuacacucaggaaucaaccacagacauaugggaagucaaagcccaugcccuuugcauuaggacacacugcuuaaaguaagugaccuuuuccacaguugauagaauuucugguguuuuguuuuuuccaagccuuuuaguacauuuuggucucuggauaacagauaacacugucugcuucucagaaucucucuugaaaacaaugcacuggauuaucauaugucacuuugcacauuccaaauucagaauaugaauggauauauaccaucuuucauuacaaaaacccuuucuauggaacaauucccaaaaucauuguguuuuugaagacugugauuaaugguuaauuguuaaaauaaacuuauuuauaggacauaacagagaaacugcagagaauuugagaaacauaaaaaauaaaauuucugcccuggcacaguggcucaugcccguaaucccagcacucugggaggcugagguggguggaucauuugaggucaggaguucgagaccagccuggccaacauggugaaacccgucucuacuaaaaauacaaaaauuagccaggugugguggugggugccuguaaacccagcuacucuggaggcugaggcaggagaaucacuugaacaugggaggcagagguugcagugagccgaaaucacgccacugcacuccagccugagugacaagaacaagacaccaucucaaaaaaauaaaaaaaauucauaaaguuuuauuaaaacacaucugcauucauuuauuuacauauuacuuguggcugcuuuugaacaauacagcugaaaugacuagcugccacagagaccuguggccugcauagcuuaacauauugacugucuggcccuucacagagaaaguuugcugacuccugauuuagacagccauccaucaacuuuuaaaaaauguugaauuccuauuaugugcaauggaauauacuagaauauaguauagauauaaaagaugcaauucuugcuaucacugucuuguacaaauauggaagaaaugaguacuucaaagucaaguaacuucuaaaaaaggcacuguuaccuaguggcacaguuagguaccauggagcccaguaaaauccucuucagcuaccugauucuguggucaugaugcuuacagaauaaccuacaaguuucuaguuaaauaauguaucucacaccucaaugaucaucaguaggaucaauaaagaaaaauacaagccaggugagguggcucaugccuguagucccaggacuuugggagaccaaggcgggcggaacaccugaggucaggaguucgagaccagccuggccaacaugguggaaacccgucucuacuaaaaauacaaaaauuagccaggcaugguggcaggugccuguaaucccagcuacuugggaggcugaggcagaagaauugcuugaacccaggaggcggagguuguagugaaccgagauugugccauuacacuccagccugggcaacaagagugaaacuccaucucaaauuaaaaaaaauacaaaaugaauaaacuaagugggcuccccacauucuaaguucaguuaaaaagaacaauagucaccacaggguacauuagguuacuccauaauuuaaauauuaugucuguuuauuaaggaacauaagggcuauccaucauccauagaaaguuuccauacuguguuuucagcuaacaggugugugugaaggaucuguucauaccauaccuagagugucacaugguucauucuuccaagaacaaauaucaaauccuguuaguaagauggcaugaucaugucucuugccauucuuuccaaugagggcagacugccauugacaaaaacuauucagagacuggucugcaugaugguugaucaauaauccucccuaugggaaacccacacaaaucaaagugugaauuugucacagagaugagaaugcugaaucauuccauuuguacaggcaaacacagaaacauauuucuagggaaaaagaucaguaaacacuugagcuaagguaggagacaggaaaaucucuauuuuagguaaaugcucacaauauuuaaagcaacuacaaaguuucuguagugugauuuaugauugaucauaguucuacaaaaaauaaccuagcaucaguuagaacaccuuuguucaucuuaccuaguacuaccuuuauaaaaccguuacaacuuuuaaaacaugauaauaaauuaaugaugaaguucaauggcuuuuccauaaagccucaucauuauuuccauagaugucaaaauucccagcaaagcgucuggcacaucauagauuacaaucaaucaaucaauauaaugaaaauucacugaaugaauaaacaaaugaugauaugauuccaaaggauaagagaggaccuacccuuaaaauaaucauuugucaaauguuugcuuggucaaagcuguugacuuggccaaguugaagguuuuuagacaagaucuuuaauuaucaguuaauuaggauguggcuggcuucaagguccuugggcaaccuauuaguaggcuaaagacaaaagugucuccuaaccagcacacgccuuuucugucuuucuaaaauuccaaaaaccauuugacaagcuguuaacuucuguagcucuccacaccugggcaauuagaucaacuuuugucuugucugugucuuccugcuuuuuauguuuuuuacuggcguuacagaagaagaggaaaagccucgggggacuuaaaaaauagccauuugaaugguaaucgcuaucucagagaaacagaguuuaaacaucaaaacacuacaaagcagugaguaccauguaauuuaacacuuuauuacauguucugguuuucauaauuugccccauguuugugucuugcaucuuacugugaucaauccaaggacaguuaaauaucccuuguuuauucccuguauuaccuaagaugguacuggggauacaguagguuuacuacaauaauuuucugaugucuuauuuucaguauauuuuugaaauauccuucugcaucuaccagcaaucacucagcauaucaaacuugcaaaaucuagcuaauccuuaaaucuaugaccaaauucaccugcuuugcgaagccuacauaagauuuauuuuauguaacauauuuauauuucauauuuuuauuuauauuaucuauuuguauauuauuuaguacuuauguaccauuauuuauguauacauaugcauauauaaauauauuuaaauauaaauauuuuucuggugcuuuaguuuaauugugugauuacacaaucuuuuaaaauuguacuuugaggagagucagccuaguuucaaauuugagcagcuaacgacuaguacauggauuagugaacacaguagguguucaagaaauguauucugaacggcagacugaaugaagacauaaaugaaguuugccacuuacagguucuuguuccagaagaauuaggcucaccacaaccacguuuaugucacuuccaauagucccaucuuuaaauaggccagaaaccuguuggaacaauggaaaucaaacaaaaucucaaaauuuucaaaaccuuagggggaaucaaucagacauauugacugaaguacgcaggcuuuaauuuuaccaaauauauguacauauaaauacaauuuccucaaaacucaacuuaaaaaaauaaaaccacauauguagcuauuaaaaguaauggcagaaacugcaauuacauuugcaccgaccuaauacaccugcuauucaacccaugcaagagaauuccaugacauuuauuuucuuuggagagccagaagguuugugacacccccgcuuaccauguucauuacugugagaauguauguggugacauuucccuugccaugcuuuuccaccauuuucuugucugccaccacgaggguuuccacauugaggcccuuuugugauuuuccagcugaucuucugggucgcccagagcucccauauucaucaaaccuuagauagguguccucugugggaggcuugggagcaucuacgaugaacagaagagcauuuggaagggauauuagagaauaucuggauaagacaguugagagagaaacugaaacaagggaagaagagaaacuauguaaccaacacaccaccaauccacuaacaagugaugcuaucagugccugcccaggugccuugcaucuaguauguggucaagaagggccuacucaauaaauguuuggaugcacagauggguagauggauggaauggacaggauagauggauggaugaguggauggauggaugguggauggauaaauggguagguggguagaaauaaauggauaauggaugaacuuaguaacucaaaaaugcucuaaaaggaaaaaaaaagaaagaaagaaaagaaaagaagaaagaaaaggaaagcaaaggaaagcaaagcaaagcaaaggaaagaaaagaagagaaaagagcucuaggccaggcgugguggcucacgcccguaaucccagcaauuugagacgcaaagguggguggaucacuugaggucaggaguuugacaccagccuggccaacauggugaaaccccaucucuacuaaaauuacaaaaauuagucaugcaugguggugcaugcuuguaauccuagcuacuugggaggcugaggcaggcggaucacuugaacccagcaggcagaaguugcagugagccaagaucaccccacugcaguccauaaggaagucucuccuuuauguccucaaaagaaacacccaaccacaccuacgcauuuaccuuuaagauagagucucugggugacagagugagauuucaucucaaacaacaaaaacaagcuauaauucuaguuaguagaauggaucaacaaaaaucaauuuuguggggagaaauuuugaaagcagaaaaugcucauuuuacuacucaaaaacugcagaaauaguguuaauccuuuggaucuaaauuuauuauuuuugaauucauuaaauauaccacuuuauacauuauuuucuaaauaaaauguaaacagcucuaaaauagugggcaugucuuaaacucucauuucaucaacacagacuuuaacauagcacauaagaagcacucaguaagaacucuuugaugugacaaugacuuaguuauuagggaaacagcauaguuggggaugauauuaaaaacuguauuaaacacuuuucauaacuggcaaagggugcgcaccaaguuaacagaauggauacuggccauagccauugagcagagaccuagaagugccugcucggccagacaugaugccuuuaguuaauggacagccacaacuacgagcauuccugggaagaaaaauggcaccuggaaagcucagggaaguaacuguguacuaacuaguacagaaauaguuuaguacuguaacacugguccagccguaauagugaaacuagcucccuacagaguaaaauuaaaagauaaaauuauuuagaguuagauuuaaaaacucagguuggccacuuaugagcacagugacguugagccucaguuuccuuaucuaugaaaacaggugacacuuguuuauaagguuguuguaaagauuugcuuugaugucucauaucaaacaugucuuaccacuauaaacaucauuacuaucauuaauacaggcuaaaucauuacucuauauaugcuaaauggaugccccuuaauggggauauuucaauaauaccaaaaacucaaaaaccaguuaaaaugguagaaacucuuucauuauuccuccugauuaauaucuuagugauaccaguuccucuucuccaugagaauaaacuucuucuggcugugguauccaacuuggcgcacaguuuccaugcacagcuacugagccacagaagaauuuaaaaguuuaaaaagcaauacuugauucagcuauugaaaaucuuuuggcugggcgcaguggcucaugccuuuaaugcuaacaauugggagaccgaggcggguggaucaccugaggucaggaguuugagaccagccuggccaacacagggaaaccccaucucuacuaaaaauacaaaaauuagcuuggcgugcuggcgugcgccuauaauuccaccuaguagggagucugaggcaggagaauugcuugaaccuggugggguggagguugcagugagcagagaucgcgccacuucacuccagccugggcgaaagagugaaacugucucaaacaaaacaaaacaaaaacaaaaacaaaaaaacaagcaaaaagaaaauguuuuaaauguuuuaaguaugucccaaacaacuugaguauguaaaucuacuuuuuugaccuuaauuuuauacaaguuaaaugcagauuaaguauuuccaauaaaaauuuaucaucugaaucgacugguuuaagugcuguaaguuuaaaauaaacgcuggauuuccaaaacuuaacaggaaaaaauaauguaacucucuaauaauuuguuauccugauuacauguugagauaauauuuuguacauguuggguuaaauaaaauguuauuaaaauucauuuacccuuuuuuuuaacuuuuaaaacuuguggcuauuagaaaauguaaaauuguauuuaaggcucguguuacauuucuauuggacaucgcuggucuggaaacggccgaagguuguaacuaagucacaaaccaugcucaaggauaccuguguuucacagcuaccucccucacaugcuaauguucuuguuucuggaagucucuccuuuguguccucaaaggagacauccaaccacaccuagacauuuaccucugucuucuuuugucauuggaaaucuagguacuuuucucggaagcacagaaaucaagacugggaccuauggcaugaaaguaggagauacuaaaagaguaaaaaagaaaccuuaucuaaaucuuuccuaguuuaaccuagaauaauugaucauccagcauuugccugagagagauaauuacugguccuacaccaagacagaugcucaggguagccccauuuugacuugcaaagcuuguacacccaacagcacucaggaaaaccugucgaggcccacauaagaacagaaaaagaaaaaguuuccuuacauacauuucuugcgucguccacaaaaaugcugcuuuugcaaccuucgauggugauacucugucucucgacucugagaugcauggggaaugugacuuggggaguaaccaggauaauuccggccagagccgggguagccacgguaccgcuggaucuucuccucugcuguccuuuuguacaguacgugaggauggugacccgcaggggagcuguaguuguguuccugggccagaagcugagguaauggcgagaugaggaauucauuuuuucguguccuuauuaaaccugacuaaaaagccaaacacaaagcaaacagucaugauuccaugcaucccugugccaaggguugguuuucaacaacugcuucugacuaauuccuguaugugggcacaggagcuaaaagcuucacacauauugccucauuuuuaucugcaccauuacaacgaguugcuauuauuauugagacaggucucacuuuaaaaccaaagcuggagagcaguggcacaaacauggcccacugcagccuugaccuccugggcucaagugauccucccagcucagccucuggaguagcugagacuacaggcacgugcuaccacggccaaaucacuuuuacacuuuuuauagaaacagggucaauguggcccaagcugguuuugaacucuuggccucccaaaaugcugggacuacagguaugagucaccguaccuggcuggacaaguugcuauuaucaccacccccauuuacaaaggagaaaauugaagcuaagauaguaaguaggaaagcuagcaugggcacccagaguucucuacuuucagaggcagggcucacaaccacugggcugccagcccugauguuugugccugaagggcugagccauggacauucugcugcauugcauuuaugaccuggcagaugccauguucaccacuggauagagugaugaauauaaaaauacccccacucauucucaagugguucacacuugauuuuucuuuuuuucuuuuuuuuuuuuuuuuugagauuagguuucauucugucccuuagguuggaguacaauagcacuaucauggcucacuguagccuugaccuacuggucucaagcaauccuccugccucagccuccugaauagcugggacuacagguacacaccacuaugcucagaaaugcggucuauauugcccaggcucgucucaaacuccuggcuucaagugauccuccuaccucagccuccuaaagugcucagauuacaggugugagccaccaguucuggcccaucuugauucacaguugcuaaaucaauguuuuuaaaaaaaaucagcaaggauggcagagaaaggcaugagugaugugaucucuaagugggggucuagagaaucugaugaguggugcuauaaugaagagacauauuuaccaaaucaagaagaaaggggagacccugggaagcccauuuaaucacaauuucauuuaccaaguugauggcacaguauggauaucuucguaccugauuuugcagccaagaugcacccuugucuuucuuucagcaaauguuguacucuaucuucucuagauaucagaguucccugauacccaagacccugcuggggaaaguguaaucugcagacuaguagcuucagccucacccaggaaccugugggauucagaaucgugggccucaccccaaaccugcuggaucaaagucuaugcuuuauugauauccucacauguuuaugggauccuuuuuauuucugugguaucaguuaugucacauuuuucauuucugacuuuauuuuaaucuuuuuuucauagucuaagcuaaagauuugucaauuuuaucuuuuuaaaaaaccaacuuuuuguuucaugaacuuuuacauucuuuuuucagucuaaauuucauuuauuacugcuuggaucuuuauuauuucuuuccuuuaauuaauuuuggguuuaguuuguuguuauuuuucaaauuccuugaggugcaauauuaaguuggguuauuuuugggaucuaauuuuggauguaggugguuaacgccaaugaauuugaaaacuaagaaagaacagagaaauccuggacaaacacagucuaccaaaacugaaacaugaagaaacagaaaaucugaacaaaccaauaacgaguuaaggagauuuaaucuguaauaaaaagucucccaucaaagaaaagcccagggccagauggcuucccugaugauuucuaucaaauuuaaggaagaacuaauaccaauccuuugcaaacuauugaaaacaaauugaagaggggguaguuuuccaaacucauucuacauggccugcaucacccugauacccaaaucagacaagaacaaaaagaaaucuacgggucaguauaccugaugaacacagauguggaaauccucaacaaaauacuagcaaaccaaauucaacagcacauuaaacagaucauucaccaugaucgaguggaauucaucucaggguugcaauaguuuaacauacauuaaucaacaaacaugauauaucacauuaacagaaucaacaacgaaaaacauaauuuuaauagaugcaaaaaaaugcauuugauaaaauuuaacaucucuucaugauaaaaacucucaacaaauuagguauagaaaaagugcaucucaacacaauaaaggccauauaugacaaacucccagcuaacauccuacagaauggggaaaaguugaaagaaagccuuuccucuaagauccagaacaagacaaagaugcccacuuucaccacuucuauucuacauaguacuggaaguccuggguagagcaauuaggcaagagaaagaaauaaagggcauucaacuuagaaaggaagaagccaaauugucccuguuuucagauaacaugaucuuauaaagagaaaacucuaaagaaacaaucaaaaaacuauuagaauagaggaacacaguagaguuguaggacgcaaaaaucaacacaaaacaucaguagcauuucuauaugccaacagugagcuaucugaaaaagaaaucaagaagguggccaagugcaguggcucacaccuguaaucucaggacuuugggaggccgagguggguggaucacuugaggucaggagucugagaccagccuggccaacauggugaaaccaugucucuacuaaaaauacaaaaauuagccgggcaugauggugggcaucuguagucgcaacuacucaggaggcugagacaggagaaucgcuugaacucaggaggcggagguuacagugagcagagaucaugccacugcacuccagcgugggcauuaagagcaaaacucugucucaaaaaaaaccaagaaaacaaucccauuuauaauagcuacgauauauauauauauauacauauacacacacacacaaaucaauuuaaccaaggaggugaagaucucuacaaugaaaacuauaaaacacugaugaaacaaauugaagagaaugcaaauaaauaagaagauauucuguguucauggauugaaagaauauuuuuaaaauguuuauacaaggcuggaugcagugacuuaugccuauaaucccagcacuuugggauuugagaucagccugggcaacauagugaaacccugucucuacaaaaacuacaaauauuagccaggugugguggugcaugccugugguaccagcuucuuggaagggugagcugggaggauugccuuagucugaaagguggaggcugcagugggccgaaaucauucuauugcacuccagucugggugacagagcaagacucugacucaauuaaaaacaaaaacaaaaacaaaaacaaaaacaaaaacggagaaaaagaaaaaagaaaacacaauccuaauauucauauggaaccacaaaaagacccugaagagcaaaugcaaucuugagcaaaaaggaacacagcuggaaacaucacauuacucaacuuugaaauauacuagaaagcuacaguaaccaaaaaaacauggcauaggaauaaaacagacacauaaaacaacagaacagaagagaacccugaaauaaaucuacucaucuacagccuauuaauuuuuaacaaaggcacuaaaaacacaguggggaaaggacaguuuuuucaacaaauaaugcuggaaaaacuggauauucauauacagaagaaugaaauuugacucuuaccucucaccauaugucaaaaucaacucaaaguggauuaaagacuuaaguaagagauaugaaacuacuagaagaaaacauagggaaaauacuucaugacauaggucugggcaaggauuuuuuggagaaaaacucaaaagcacaggcaacaaaagcaaaaacagagaaauggaaguguaucaaucuaaaaagccucuguacaagaaaggaaacaaucaauagacuaaggagacaacccacagauggagaaaauauuuguaaacuauguacccgauaagaguuaauauccagaauauguaaggaacucaaacaacucaucagcaaaaaauaacaauaauaaucugauuuuuaagauggccaaaaaaccuaaauaaauacuucucaaaagacauauacauggccaacagggguauaugaaaaaaaugcucaacaucacuaauuuucagggaaaugcaaaucaaaaccauaugagauauuaccucaccccaauuagaaugacuauuaucacaaugacaauaaaugcuagcauggauguggagaaaugagaacugcuacacauugugggcaggaauguaaauuaguauagccauuauggaaaaugguaugaaggauccuuuaaaaauuaaauauaguucuaccauaugauccagcaaucccacuaccggguauuuauucaaaggaaaugaacucaguauguugaagagauaucugcacuccaguguuuauugcagcacuagucacaauagccaagacacagaaucagucuaagugucugucaacaaacaaauaaaaaugugguauauauacacaauggaauacuauccagccauuaagaucaugaaaucuuguaauuugugguaacacaggauagucaucucaggagcuguggcaucgacaugauguguagagccugaaaucaaagacggagucuucauucacaagcacaugcugggcaccugaguccugguccuguuucaggcauugccauaaacaagaaugguacacaaguaaaugaaaugguucacauucguggccuuaugaagauuaugggacaagagaaucaauaggcaagauaaguaaaaucucagauuucacaacccgagaaaucccagccaucauaucuucaggauauaccucagagaagcccacccuuccagaucuagcacacaucaugcugguagaugcucgcgucucuuauuuggacacuuucuauugacgucccaaaucccaccuguccuauccaauaggguuuccccacaacagccagaguccuuguccagcacuaaucaacuucuuccauucacucugguauuaaucacaaauuccugacccacuaaucucugcauaaucaacucccugcagaaccugccagcuuuaucuguccucucuuccucuucucacaccauucuaaacaggacgcuccuuucacuuuuugaaccuaguaacuucuuccauacuaaauggcauuuucacacauuuuuuuucuuuccccuacagucuucuccuaucaauucacuuggcuuucuggugcucauugcugaugucucaauuuaaacaccaucuucucagagaagccguacucacgacccuauugaaaauuauccucucagccagguguggugguucaugccuguaaucccagcacuuugggaggcugaggucaggagauugagaacauccuggcuaacacagugaaacccugucucuacuaaaaauacaaaaacuagccaggcauauagucccagcuacucgggaggcugaggcaggacaaucgcuugaacacgggaggcggagguugcagugagcugagaucacaccacugcacuccagccugggcggcagggcaagacccugccucaaaaaagaaaaaaaaaaaaaagaaagaaaagaaaagaaaaaaaaguuauccucucucaugcaaaggcauaagaaugauauaauggauuaugaagacuugggagaaagaguaggaguggagaugagggauaaaaguguacaaauugggugcgguguauacugcucagguggugaugggugcaccaaaaucucacaaaucaccacuaaagaacuuacuuauguaaccaaacaccaucugucccccaaaaaccuauggaaauaaaaaaauaacaugaagaaaauuauccucucucacuuccaaauaaucucaggucacaguuuacuggcuuuaugucuaucuucaauaaggaaacaaaaugcaacccucuccccaccaucccucauaugcaguuuuauugcacacucugugacagcaggggucaccugaguaucucugaugcaugccacuuguuaucagcuaguaaauauuuguuucuccaggcagggcaugguggcucacacuuguaaucccagcacuucaggaggccaaggagugcagaucacgugaggucaggaguuauagaccagccuagccaacauggugaaaccucaucucuacuaaaaauaugaaaauuagcccggcgugguggcaggcaccuguaaucccagcuacucaggaggcugaggcaggagaauggcuugaccccaggaggagcaguuugcagcgcacugagauugcaccacuacauuccaaccugggcaacagagugagacuccaucucaaaaaaaaaaaaaaaaaauuguuucuucauccccagacuuuuuucagaguggaggugaugcugaaggcaugccaauaucagagaaggaaaccagacauaggaagugacaauuucaagacuauaaugcacaugaacuugucuauauuucagacgugaagccauaagcauucagugcaauaccuuaaccuaaccuuacaacucccugggaggaaaacccagcaggaagcacaggcagaauuucaggucccucauucucugagaaggacccucuccaugcccucaccucuuucaagcugcaugcagaccaaaaacaccauuuaaagucccucacagaauagaaggaaaaaaaagugaauuaucccugaaagcccuccagccuuacuaacuuccuuacuuggcucaacuaauaucaaaggcuuaagccacuuaagugcuuuaacuggacuaaccgguuuggaagcuuucuauuuucucccuguuacaugcaaacugcagacaacucaaaugcauagagaaaacuuccacacugagaaagcaauuuaaaaaauaauaauaaugggcauccuauauugagacaaacacuuugucucacauagccugucaucuuccuauucagagugacaaggacaaaaaucuagaagaauucuuuauaacaaaacaagaauuuuacagugcuagauauuaaaaaagaaaaguauuauuuuucugcuuuaguuugauagaaaaccuuggaaucuaaccaaauaaauacauuuuauugcuuaaaaauauaaacccaauacacccaaaagaaaccaucuguuuauuuguggaguguuuaaagcauuuugagauaucgaaaacaagcaaagucuggcuugguaacagugaaugagacagaucuguggucucccguggccuccaauucaaugggggaaccaggggcuaaaccagcaaauaucacaaaugggaaugaaauauuauuccucuguauaaaguguaaagaaaaagacgggguuucaccacauuggucaggcugaucccgaacuccugaccucaggggauccgcccaccucagccucccaaagugcuggaauuacaggcaugaaaacccgucuuuaccaaaaauacaaaaaaucgcaccaccgcacuccggccugggugaaagagagagaguccaucucaaaaaaauaaaauaaguaggaagaaaaagagcaaaguuccaugagauaaaauaauagaaggggugagaggagcggggaagcuaauuuuagaggggagguaacggaacacuuuucugaggaggcauuucuugugagaccggaaguccucuccugguccacgauggggaaguccaugauggaacugagagacugaugucucagagcuaaggagcggaagggguggugagaacaggaagaaagcagagaccaaguggccugcuaagaaggagauggacuggggacgcccuuaggcuccuccuacaauaaaggacaggaaaggccuggauucaucguucucucauugcuauaaagaacuaccugagaauuggguauuuauaaagaaaagagguauaauuggcucauguuuucacaggcuguacaagaagcaugacuggaagccucaggaaacuuucaaaacuuccaaucauggcagaaggcaaaggguuuuaugucguuuuuucuuucuuuccuuuuuuuuuuuuuuuuuuuuuuuuuuuuuugagacggaguuuggcucuuguugcccaguuuggacugcaauggcacgaucucggcucacugcaaccgcugccucccggguucaagcgauucuccugccucagucuccugaguagcugggauuacaggcaugggccaccacgcccggcuaauuuuguauuuuuaguaaagacgggguuucuccauguugauccggcuggucuugaacucccgaucucaggugauccacccgccucagacucccaaagugcugggauuacaggcaugagccacugcacccggccgcagacacaucuuacauggcuggagcagaaggaagagagagugaagggguaugugcuacacacuuuuaaacaaccagaucucaugcaaacucacuaucaugagaauagcaagggggaaauccacccccaagauccaaucaccucccacccuuccuccaacacugggaauuacaaauccacgugagauuuggguggggacacaaagccaaaccauaucaggccccaaguccacuuagauguggcugccaaagguugauggugguggaagagcugccccaacucuccacccagggaaccaaccccuuccccucaagagacaagagucaagccgagggaaaggacuggguugcgcccgcuacuggacucugugugcugcagggucaacucacauugcuucuuccugcauuguguuuugucuuuuccagaagauacagaaauuccauuaugugacuuagcugcuaaagcuuaaaaauuaaauugauucugacccagagucaauauucuauuuaaauaguuuaauguuuuauucuuuaaaaugagaaaaaaacaaguguuuuauuugugaacagguguuuucuauuuuagauuucaagggccuaaaucauucuuuuuuuuuuuuuuuuuuuuuuugagacagggucucccugcaacacccaggcuggagugcaguggggugaucucagcucacugaaaccucuaucucccagguucaagcgauucuucugccucagccuccugaguagcugggcuuacaagcgcccaccaccacucucggcuagguuuuguauuuuuaguagagaugagguuucaucacauuggccaggcuggucuugaacuccugacuucaagugauccaucugccucagccucccaaagaucugggauuacaggcaugagccaccucauccggccucaagggccaaaauaauucuuaaaggacucaugccagguauaaaucacacuuuaugaauuuucccuaaaguuuccuuuaaaauauacucuucauuggucauauuucaauuccaucacaggcuuuagauuuaacagaaaaagggagacugcagccuccagauguaacugacaaauucaguguuaggaugagugcacaauuaauuuuuaauaguucagugugaagagcuuuaaagaucaagaaaauuaggaagcuauaaauaagcuuccugaaggcagggaccaugucuuaagugauuuguaucccacuauuucuaccuauuaaauaaucaaaauuuaaaagaucuaaugaacgaauaauguuuguaacaauagagccagaacuucaaauagaaugauguaagcauaucuuaaagaaguauuugaaauaauaauaaaaacagccccaugggcaguaucauuauucuguuuuuauuuuuaguaaagacuaauucacagauaguacaaaguagccccaguaggcugccuggaaaaauacuagcaaagacauauuuguggucaucaauaauuaauuuauuuuucacuuuuuaauuuugaaucuaucugcaacaacuaaaaaaugcucuuaccucagucaagaugucacauucuuuaaaaauuuuuuuaaaucuaagcaagaacacuaaagaguaagucauugauuuguugcccaacauguacaagaauagccccaaaugagaaaucucaguucagaauaagggaaagacuuaaaguauaaucaauaugaaauagaaauucauaguccaggggcuggggugaggauggagggaaagaaacaucagaaaaauuaaagacuaaguaaagaaaaugcugagaaagucuuugaggaaaaccauugguaaaaggauguuuaggauuuuauucagcagcaaugggccagguguuauagcacaugccuguaaucccagcacuuugugagucuaaggcaggaggaucacucgagcucaggaguuuaucagccugggaaacaccacaagauccaucucuacuaaaauaaaauguuagccaggugugugugguggcaugugguauagucccagcuacucaggagauugagguaggagaauugcauuaaccuaagagguugaggcugcagugagcugugauugcaccaaugcuguccagugggugacagagugaggccuugucucaaaaacaaaaacaaaaacaaaaaaaaacaaaaaaaaaaaaaaccaagcccuuuacuuagaugauuuuuuagaggauuaaaugaguuaauacuuuuaaugugcuaaaaacaggcugggcacgguagcucacaccuguaaucccagcauguugggaggcugaggcagguggaucacuugaugucaggaguuuaagacuagccuggcuaaaauggcgaaacccugacuccacugaaaauacaaaaauuacccaagcauggcggugugagccuguaaucccagcuacuugggagguugaggcacaagaaucacuugaacccaggugacggagguugcagugagcccagaucacaccacugcacuccaaccugggugacagagugaaacugugucucaaaaaaauaaaaauaaaaaaagaaauaaaagugcuaaaaauagugcucaggacauauauaacacucaauacauauuuauuaucauuaugauuauuacauuugacuauuugagggaacaagaagucaagaagucuggccuuuuucuaacaguguguuuauauuauaacuuuccccuucaguuggacuugaaauucugggaaguagcauaaauauucuuucaguuuauugagaaaaacaaugaaagaacuaagcaagguuugaagaccugaaaagacacauauugaugaaauucuuacagaaguaacugaagauauuuaaagacagaagagaaaccauaaauuuuucuaccuuggacagaugaucaauccaaggacucuagguuuuaguuuugacugguugguguguuuugguggggaugggaaagagaagugaccaauggcaaggaaauuaugaggcugcuucucucaugaggcgccuucuugggccuauuaacuucaccaccauaagguucaccaauucaaauguuuaacuccagccuucguccauucugaaggcucaaucucuuauccuccugcuccacugaaaagcagcaacaaucucuuuuugguuuggcuagcaucauggggagaagaacgcuugcuacuggccuuaaagaguaaaugaauggcuauugcugggagaacuaagcaaaguggacuuuauggagaauguggcagaauagacugugaccauggacuagaggugucaccuuauaugcuggcuaucuguuuauuuuuauuuuauuuauuuuuugagacaaagucucacucugucacccaggcuggaguacaguggagcuauuucggcucacugcaaccuccaccucccagguucaagcgauucucccaccucagccuccugaguagcuggaacuacaggugcgugccaccacaccuggcuaauauuuuguauuuuuugguagagacuggguuuuagcauguuggccagggugaucucaaauuccugaccucaaguaauccacccaccucggccucucaaaguacuggcauuaaagguguaagccaccgugucugccccuaucuguuuaagaugagucagguaaaggcccuccccuucccagugaacaccugagcacuucaaggucacuucacagauguucacugaguccucuccgccugugguucacgcagcugcaucacugggcaaaguugauuuguccaaguaauccugaucuccaaucuuggcaugcagugucuaugcacucucagucucugugacuuucugagucaugcugauaacgguagacuagaaaaaagguuccaaaagucuugcugccgagguccucagaaaugcuuggcuuucuucucuucccucaccugggauguucagcuacuucaaauacuccaauaggcucaaaaugaauuauccuuucacuuuacucacuaacccacuggggcuccagaacaacauuaacuaacaugacuuugacuauaugcagugguuuaugcuccugacacaaagauuaacagauucagucucugucuucaaagcccuucaacuauaaccgucuguacggauguaaaugucaucuagcagcucuuaauagauauuaauaacauauugaugaaaauugauuuagcuaauuauaaucucuacugaaauaaacacuuaaugacuucaacagcucaaaucccaugagaccagaauacagcgucauggcuguauucaaaacucuguauugguuuggaaaguauaagcagauucuguccaaguuaugccugugcccauucucaaaagaguauguaccucuaagaaacucuuuuuaagcucuauguacuaauagcaaaaugguugauauucuuaacaucuacugcauacauuuuaauauuaaaaaauuaaauguaaaaauguuaaaaugcauauaguuuauaagcagccauaaccuaugcuucagcauuuauaaauuaaucucagugguuuaaucauaaucaacagauguugguauggccccuuccuucuuauucucccugccuuccuuuaacauacccaucugggggucagugguuccuaugcaccaggcaccgcacauagcauuuuaucugcagaauuucaacugacucucacugcagcucuauuuguuuuuuguuguuuuaauuuuauauuuuauuuuauuuauugagacagggucuugcucugucacccaugcuggaguacagugacacgauaucagcucacugcaaccuccacuuccuggguucaagcaacccucccugccuccgccuccggaguagcugggauuacaagugcugccaucaugccuggugaauuuuuguauuuuuaguagagacgggguuucaccauguuggucaggcuggucucaaacuccugggcucagguaauccgccugccuuggccuccaacagagcugggauuagaggcgugagucaccaugccuggccuugcagcucuaccugauggguacuuuauuaacacuucuauaucagggggcugucugacuccauggccugcccacacucuuaaaaaacacacauucuguucagauucaggaaagguuccagagagggugggggugggggacagcugaaaugcuggacucugaagguaugacucuuuaacaacaaaccaguuuugggcuggcauaauggcagaagguccuagccucccgccaaguaccugcuguuccuuucccugcuucaaaaggaccagaaaaacaaagagaugcaaguaaacucaggucauucucagaagugagugcugagguuaaguggcauuaaaaucagagagucggcugggugggguggcucacgccuguaaucccagcacuuugggaggccgcggcagguggaucacgaggucagaaguucgagaccagccugaccaacauggugaaaccucgucucuacuaaaaauacaaaaauuagccagcuguagugacgcacgccuguaaucccagcuacucaggaggcugaggcaggggaaucacuugaacccaggaggcggagguugcagugagccgagaucaugccacugcaguccacccugggugacagagcgagacuccaucucaaaaaaauaaauaauaaauaaacaaaucagaguccucucaauuuucacaccaaaaaguaugaaaaaagaaaguccuguguuuaguggagacacugagaaagcuucccccauggauccagacauaccuggcucaauuguucucuggaauguguccuuacuggucaucaccaaucuaguucagauuucacccugaaaugcucuuauucucucuuuugugggguauauucuacguacuuucagggcagaacuggacuacucugccuugcaacagccgcgccacauccugaaugccagagauacuccacauauauuugggagagacauauccacaauaauaaaagauaccauaucuucccagccccugagauagccaaauacacacuaacaaccaguuuuugguuuuuuguuuguuuguuuguuuguuuuuuugagacagagucgcucuguugcccaggcuggagugcaguggcgcgaucucggcucacugcaagcuccgcugcccugguucaugccauucuccugccucagccuccugaguagcugggacuacaggcgcccgccaccacgccuggcuaauuuuuuguauuuuuaguagagacgggguuucaccguguuagccaggauggucucgaucuccugaccucgugauccgccccucucggccucccaaagugcugggauuacaggugugagccaccgugccuggccccuaacaaccaguuaaaaggacagauacugaagcuacaugaccuuuacaagugguuuggucaugaagacuuucucaaucuagggaagaugaaagaaagcuguuugacacccuugugccucauaauccucuuuccuccaugcuuaugaaugugaucauuucaaaggaagcuuaagguuaucauuuggaaaacacaugacugccacaaaggcuguuggugaacugugaaugaccaagacgacagcuagcaugucucgauuuaauggaaaccagacuuuccaugaaguucacaugggaacaugcagccaaccuucccccuggaucauuccaggcuuugcugcugggucugcuaauaacacuccucuucacacgucagcauccuuggaaagcggcggcuugaaugucugggaggagaagauccuaccucauauccauguaaguugugugcuuuaaugugaauuuugugauccaauguuguguuccccuccuccaauccuucuuugcuccaaacugacauccuauggaauguggcauuaugcaguuaagaauacugacaaauugcgaugaacaacuaaucucuugagcuccucucucugucccuccuguguucucauuccagucuggucauguauugccccaagccuagacuuagcaguggucuccuaucuccucucccuguugacaaucucucuucucccuugcuccagaguuguuuuuuccaaagcaucgcuuuuaacgggucauucaccaucaugcucuaucacuacaagaugaauucuugaccaagagaaauggauuucaagacacuuugcagccccguccaauccaaaugcagcaucuaguagcuucucuagcaucuucuaccucuuauuuuuucuuuuaacugaauuccagcuacauucacuccauugcuguucuauaaauaaaaaagccaaguucccaucucagauuuuuuucauuugcuguuuccugugccuagaaugcucuuccccuagauaucucacuucauguagguuuuuguccaaaggcgaccucuuuuuuguuguuguuguuggagacagagucucccucugucacccaggcuggauugcaguggcgcaaucucagcucacugcaaccuccaccucccagguucaagcaauuaucugccucagccucccaaguagcugggauuacaggcacccaccaccacgccuggcuaauuuuugugacuuuaguagagaugggguuucaccaucuuggucaggcuggucuugaacuccugacaucgugauccgcccuccuugaccucccaaagcgcugggauuauagaccggagccaccgugccuggcccaaaaagcugacuggggaaacaagguuggcuuuguuucaauaggaugcuucaaaggucaccuguucaaagcauccuuucaaaugaaacaaagccaaccuugucauuuucucagucagccuuuuuucccccauaacagccuuuaucaugacaugagagugccacacgcagcuguuuccuucuguguuuacuguucaucccuccuauuagcuccuuaaaggcugggacuuugugccuguucugccgacuucccuauguccauuguuuggcagcugguaggagcucuguaaauauuuuugguauuaaucaacuaaaaauaaagcaauauguauggugcuaagggagacauaaaaacaagcaagacuucaacgucuacauuuaagaaacuccucuacuucuggagcuaaacacauccaauuaaucagaaacauuauauccuuuucccauuucaccauucugauuuacacagcccccucguaggcuuccauaccauucacagcacauaucaaggaaacaauuauuucucuaguuucucucucuuucccuguaacauaaaucccuggcaaagcagaguugauguuguauuugauuuugugcccuuagaacucagaagguacuggcgugacacucaaaucauacugacugaauaggggaauaugcaaaauucucuaagaggacaaaguuagggcagaccaucucugaggguaguguuugaacuucuguacauuggggaacgucugaagguuuugaauggaaaagccauaaaaaccaauguacguuauagaaaacccuggcuaacacccaacuuauggggcauuucuacugccuguagcagugaagauuguacuaauuuaacccuuuauauucugccuggcauuacugugaaauaugacaaaaauuuagacaagaagagaaacguauauaguaagcuacauuaucuaacauccaguucaucagcucuucuucugauaccauuuuugcuucagauuuuuuuaaaaaaucucaacauuucauauauaguuaucaaaauauuuaaaucuaaccuccccauaacaaaucaguucagauaagguuuuuuuuuuuuuuucugagacagagucuuguucuguugcccaagcuggaaugcaguggaaugaucucagcucacugcaaccuccgcuucccagguucaagcauucuccugccucagccucccaaguagcugggauuacagacgugcaccaccaugccugucuaauuuuuggauuuucaguagagacaggguuucaccauguugaccaggcuggucucgaacuccugaacuuaagcgauccacucaccucagccucccaaaguguugggauuacaggagugagccaccaugccuggccauagauaaauauuuugauauaagauuaguaucccuugucaucgaaagucuaacuccuuugcuauuuaaauuaucauuauccaaauguauuugguuucuaaguuuggauaguaaggaauuuauacuugauucucaaugcauguuugcugaaaauagugacuuucugagaaggaauaguugacuuguauucuguaacuaagcuggugcugcauaaauagcaucuaccacauuugcaagacagggauuccaauuuuuggaaucagugaugcucucccuucccaaggcugcuggcuugcugaugcacacuaucagaaagacacguguuuuuacuuguuucuguggugguaauggguuaugucaagcucuccacccaacccugcccugccucccuuggaacugacagcauuuauuuguuaaacagacagcuggagcuggaagucuaggaaucagcuguuaagagaugugauuaaguacgcuacguggcaucaacccauugggcaggugcacaguggagcuggaugauugacaggacuucccaagcucucccaggggugggguggaagagccagacaugaccaccauguuggaaacagcuggucccaauuuuuucucaguuauuuaucuuuuccugccccuccucacccccugccuugagguaaaacaaagaaaaauaaucauaggauuaagagauguuagcaauugugcaguccaucccccugauuuuacagaggaaggaaaugggaucuggggagaacaaagaacuguccaaagucucaaaagugauuaguagcagaacauuucuggcuagcauuuaguuuuccuaucuauuugaugaagugauuggacuugguaacuuagugguuauuccacaucugaaauucuauuucuuuuucacuugggauguauguaacuugccgugauacaaaguacaauuucugcgcaagacagcaagcucccuggacagccucguguacacucagcaguaaaaguguuuugaugcugcugcauauugucagagcccaguuaaggggcucagagcucaucaucaaccuggcugaccaccaggcuuaaagaugcaaauaccuauacccaacuuggacuuuaggauccaaauuucuaagguuuuaaaaccaauuuuauaaaauagacuacaaaccuauaccugcaggcccaaccuggacuucgacagguuuuguuuguuccucucugugcuaacuuuucccuagaggaauuugagcccaauauugucauuucauccaauuuuucaagagaagccauaaauuccauuuuguguguacaacugcugggcagcagcuagagaguggccgccccauaaagauguggcauaagcucuccaguucaucaaagcccuaccccuucugcaucccucauuauauuacuagucuggugccuaugaacauuugacuuugugaccccugcccuaauucaaccuuauaguugaugcauuucuuaugcaaaagucauaucuugcuagcuagggcguuucuuuuuccuucucuuauagcugucagaucaccuaucacaaagcuaagaaauccauauauacccaaagauaguuuuuccucaguaauuacauuugcauguaacuuauuacaugcaaauaugagaaaacaugaggaaaguuggaauagaagcauaguuuauuuaacuuugugaaaucugugagucugcaaauucuuggugcuguccuacagcaacaaacuacagaagucugcaaauggguaaacacuucuguugggugaacuaugcuugccuucuguagcauccaaaaugucacuccaaacagaugcuggggaugacagcagagggcuauuugcauacuaauaugccccacccagauucagaugcagagggacauagauaagauguguuaggcaaaugcacaugcgguuaacucgcuacauguaacugagagauaaauggaauguaugcagugauuuccaacuuuuuccuccugcugucaucgauuuucuuggcucaccuaaccaucaugcaaauucucuuccuguuacaaguacaguguggcaggaagaaaaguggcuuucuugccaaacucuggcucauuuccaucucaugucggauagucaugggucauggaucacuuuacaauguuuuucaaaauuuaagauggcucaggucaucgcugucacgggauaaauuauauuucauaaaccaaauaugucuaggcuuccagauuaccaauaaaagcagauaaccagcuucuuggaaacaaucucaaaaugcacuacucaagaguacacacacagaggaagcucuguccuaacucugaccauucauaccuccuucacugcaaauuacuccauaucccuuuucauuuuaauguaaagcauuugaaugcaaacugcuuccacugccaugucuuucuuguaaugaggcgauuacaagcugcguaucaguggcuugucaugaucacauuaagaaaaucagcagcuggauguugaguuuuuuaacuucugccaaaaaaauuuuaaaaaguuuugauucuccaaccauagcuaagauaacaugugaacugagauggcagccaaugucuuacauuuguccaucgacaagacugugaguaaagcaaccuuuucuauccaggaguuuauuuuuuaacugaugacuccugcccccauuugggugcugcagacucauccaugaagcuggaaugagaaagauggugccugcuccuguauucucuauggcgcuaucucucaccacuacacuuacucccaacccccauccuuuacugcuuccuaggauggcagagcuuuccacuguucuuuaaaccagcuaaaccuguuucugucuuucucugguagaagcuguaggcacuacgcacucugcaaggcuagauucaccuacucagaaagcuuuucuucuuuugagaugcagucucacucuguugcccaggcuggagugcaguggcaccaucucagcucacugcaaccuccgccuccuggguucaagugauucuacugccucagccuccugagucgcugagauuauaggucccugccacugugcccagcuaauuuuuguauuuuuauuggagaugggguuucaccauguuggccagacuaggucugaacucaugaccucaagugauccgccugccucagccucccaaagugcugggguuacagguaugagccacugugccuggccagaaagcucuucuaugaccaucucaucaaaaacacuucucuuuaagucauaauaucagaaaacaucgugaucacgccacagacuggaaccaaauguguggguucaaauucuggcucuacugcuuguaaggcgugugaacuuggaugaguuacugauuuuugugccucaguuuauugaacacagaaugaggauaaaugaaggauacaggcuugcucugagcacugaaggcauaaauauauauaaaucacuuacaauaaugccugccacacagugagugacuagugggcccauuucauuugcugcuucacggucugaaaauacuggguuucuugauugacugguuguuuucuuccccucagcaauguucagggaagcagaaaggagaaaccuuguauauucugguccaguuuuuuaauccccagauuccugguaccaggaguaguaucucaugccuaacagauucugaauaaguguuugucgauuuaaugacuaauguccaaaugguacuuuugugucaagguagcaacuucuaaugaagcuggcagcagucaacuaaaugaagaagucauuagguggagaaucacugaugugauuaaguaacaaauaaaaacaagaguaggcugggcacaguggcucacacguguagucccaguacuuugggaggccaagguugguggauaguuucagcucaggagucugagagcagccugggcaacauggcgaaaccccaucucuaccaaaaauacaaaaaauuagcgaggcaugguugcacauaccuguggucucagcuagucaagaaggaggcugaagcaggaguaucacuugagccuggaaggucaagucuucagugagccuugauggugccacugcacuccagucuaggcgacagagugagacuuuaucucaaaaaacaaagaggaguccaaucuuuacaugaucuaauuccacaaaaugcaucuaagauuauagcuuaagugaggggguagguuuuguuuguuacaguuuuguuuugugggaguggcaugguguuacggaaaacuccucucaugacagugugugucugucagguuaauucguucaacaaacguuuguauuuauaaugggccaggcacugaaguaggaccugcgaauaaguaauggagcagggcugaaugaagcccucaggguagucaguuucuuaccaggaagaccucuagcugcaccgacaucacaagacagccguuuucugccuacuuggaagaccacucaaggcaccugauaaauucuucgaaaggucucuuagaagaggugaaucuuugccuuccuuaaagaggcuaagguuagccaagugaacaaagagagaaugggggaaggaacuccaugugagggagcagaggugaaauagagacaggagcucaguugcuugcagcuauuugauuuuuuaagcauagaaucgaucugugcacugguaugcauaggcuguuaggaguaaaaagugguagauuguuuuuagaagcccuaaauauuaauaagauaacgugugcccacaugugauucaaaauaaaaauauuagcaaaacugauguucagccaacacugaaauagccagaauucuacaacuuggaauaaaaucuacaaaaucuacuaugcucauuaaugcuaaggacuuugagcuuuacccuaagaaaaaugcagacuccucagggauuuuaaagagaagaguggcuguggcugcacuguggaggauggauuaaaacaaagacaaaaacugagaccaagaaaucaaucagaagcuauugccuggguuucugcaagaaauaacggcaguggaaaccaagcaaugaugguaaagauaaaguaaacaaauuuaaaaaauaauaauaaauguagauuuaucaggguucaacuacugguaauauguggagaagaaaauuuaaggagguuacucagaucuuuuuugcagguaacuguguagaucagagaagagccauuggucucacuuuuuaucaucugcaaagaaucaccccgcccuugccaggugcgauggcucacaucuguaaucccaguacuuucggaggccgaggcgggcagaucacaaggucaggaguuugagaccagccugaccgaaauggugaaaugccgucucuacuaaaaacacaaaaauuagccgggcaugguggcgugugccuguaaucccagguacucagcaggcugaggcaggagaauugccugaacccggcagacggagguugcagugaguggagaucgcaccacugcacuucagccugggugacagagcaagacuccaucucaaaaaaaaagaaaaaaaaaaaaagaagaaucacccagcccugauggcuuccuuuagacacucccuuuaccccaccuggucugcacuguucaguacaguagucacuacccauaugugguuauuuaaauuugauccauuacaaugaaauaaaaugagaaauucagugccucaguuauacuaggcauauuucaagugcccaguagccacgugguuggcagcuaccauacuaaacagucuggaaaguucuauggaacagcauugcaaauuauugccaaauaugucggugaugcugccauuucucaugccaccauccuuccaucuacucuauccaaucucaauugugcaugacuccuuucaacauuuacauuuuguuuuuccuuuucaucuaaaagacaucaagccacuucugaaaucaggagugucuaucuacauaaaggcauaaguuaaacgcacaaauaguuuggaagagaaaugugccagauuagaaaccaaaucuuuauaaguccuuuguuuuauauaagacuaaaagacaggccaggcaugauggcucaugccuguaaccccagcacuuugggaggccaaagcgggcagaucaccugaggucaggaguucaagaccaaacuggccaacauggugaaacucugucucuacuaaaaauacaaaaauuaggugcaugccuguagucccagcuacucggaaggcugaagcagaagaaucgcuugaaccugggagguggaaguugcaguuaagucgagaucacaccacugcacuccagccugggcaacagcgcaagacucagucucaaaaaaaaaaaaaacaagaggcuugggacaaaugagcuggaaccugucaaugucaaauaacaaguaauuguuugaguauuccuaacagaguaccaauggccaggaagagggggaagagucauccuaaugagauucaauucaucuuccuuuuaauaguugcaaagaaauuuguaaauaaccuauaaucugcugggguuagaaacagaaugacaauaucugaaaaugacaacaagaacuacaacucuacucgauuucaaguuaaacagaaagaaaagguauuguuuuguuaaugaaggggucaggcaaggggacccaggaauucauuuuagaucaagugauacagauauuucacuuucugaguuuucuaaagagccucacaaagggauccauccacaucauggaaagaaggugguuuggugaaacagacagaggugcucuaacuuuaauaaauguaauugauacugccauugaaaaaaugcauuucauugauuaccuauguucccagaaacuuuaguaucagaaaaacagucucuccacauugaagacgcccagucauugugcagaaaaaucgaacaacaccaagacaaucauguaaucaauugcugaccacacagaugugccaggcacaccugauaaugcucugggacagaagacagaaucgcgugauaccauccacuccucugcuccaaacccuuggcuggcuccuguucagcucggaguaaaggcugaagcucucaucauggccaaguaguggugucacgcuaauuuugugauuugcaugaccugaacucaccccuucuucuuugacuucauuuccuagugcccaucccucauuaacugagucccagcuacacuggccugauggcugaucuuggaauaugcccaguauggugcuccaguguggagcauuuuaaaguccugcuuauucugcccuaaacacuucuccccauuggguucacacccucauuuccuccuacacguguccaccucagagaaaacuucccugaacacccuguaugaaaucuccaccccaucacuucccaugccugcccccugcuucacuuuccuucauuacacuuuacccccaacagauucgauagauucuaaaugccuuugccuaugguccauuucuacacuagagugcaggcaccagggauacaggcacugcuguauucccagugccgagcccuguuccuagcauaggguagacgucguaaauauugguugaauaaaugagugccucuguccugauggaauuuacauccuagauggcagaucucugugcaaaaauaucaagugcuaaaauuacaucuuucugacacuacaggaaugucuuucauuuacucuucaguuuaaucaggcaauaaaugagaaggcguaaauggcaucuauuaaauccuuuucuaugcugacuugaugagugggcuggcagagggaacuuuuagacaguauggagagcucaugguaucugaaaaagcaggaaaauguaggcaguaaagaaaaaaaaaggacccagaaucaggaaucgauggguaccaucaaaggguuaaugcgcuggucaugauuucacugaaagucagcugcauuuugaugaaucguauuuaaagcacucuaaaacugaaagaguacccagggaccaucuggucaccauggaggugaaaacagauguccagagcagaacaugacuuguucaaugucauggaguggccaugcucugccuagaacccaaugugcagcccuccuggguacaacucgaaguucagggcagucauuauuacgccauagcccuaauacuguggucucaacaugaaaggcugccugaggguuugcauucauccaauagggaagcaggcugguuugagccagcaggggcuaggcugcuuacacuguuacacaugaacgaauggacaggguucuaaacccugagcugacauacagacuagcugcuaugaucugaauguuuguaucacuccaacauucacauguugaaacccaaucaccaagaugauggucuuaggagguaggaucuccugggaagugauuagauccaaaaggcagauggaaagaugagugcccuuauaaaagaggucccagagagcugccuugcuucuuccaccacgugaagacacagcaagaaggugacaaucuauaacccagaagagggcccucuccagaacuggaccaugcuagcauccugcccucagacguccaguuuccagaacugugagaaauacauuucugcuguuuauaaguuacccuguuauggcagcccaaguggacuaagacaccauccaaacaaaacacuucugugggcugggcccauuaugguccaaaggccucuacugucgacucuuggcuguagguccauucuuucuucaacuguccuuugacaaacagaagccaagcaugaggaacauauccauccaguaggauuuacuuagccgggauguacaccauauucagcugguccuggcuaugaaccauacauguggucuaauuggauuacugcugcugagauauuugauucaaguuaacagggcauuacaugauugaugacgauuuuauuuguuuuucaagaccaucagcuucauuauaaagauugauccccuggaauccauuaaacuugauaucacugcacauuaaaaugcauccuuagcagccauuugcugggguggaaguggggaggauaaugaucccauuuccaaaggguuuuuaaaugcagucuaguccauuuaaguguguuuguuuauggacuauucauugcuuugugucuggagacagcugguggucauagaacagguaagaaauaagaccuaguuuuaauuucugguuacuagcuaggugacauuuuucaguuauauauccucuccgagcuucagggaucuuauuuaaaagaugaaaaagacaauagcuuuauuugggggccggcaugaggauuaguuauuugucuaguaccugguacacagaaaaauguuaguuauuaguguuaauggagaagaaaguuuucagggaaagcaaaaaaaacuaaaccauuagaaauuugugugaaaaggaagugaucaguauuuaaaaauaccuuaauauacagaaagaggaggguggaaaucuauuacagauuaagauaaacacuuaagugcauuugaaauuacuuuuugaauaagaauaaaauagcguucucacccaaaauuugacuuaccacgaaaauuucaagaaaguauuuagcauaaaaagcaggcaauucuuauauuuuuggaauucuacaacccgauaauaaacuauaacugauaaacauuaauguaggauugccaucauuaauucaucaggcuugagaugguccuuuagcauccguguuuuuacaagcuccaugggugagccaacugggccauccucacucuugagugcacagcaaaacugcaagacaacaugaccaucugcuuguaaguuacaaguccauguuccuuccaccauuucuaucuaggcucucaacaugcagaaaacccuaggcacaugaagcugcauuugccuguggcuagugggacuauggaugaucuucccucaacagcagagcuucacaacaacuuuauuucugguccaaggaggucuaaggaaggauacagcaagcugccauaccagaagagaccugaggaaggcuggugaaauucacauuuggggaaacuggaaacucuucuuaggucuuucugaaucaauuagcaguuaguaaaugugaccugagaugggguuggaagguggguagggagcguuuguaggggaggccaaaguucucuggaaaaccaguaagguccuuaggacuggccucugaaaaccucugcagccugucaaggacucuguuacuuggcuuucuacucuguguggcuccaucaugguagccucauugguuccccaagucagccauacuucuuccuccuacagagcaucuugcacaagucauucccuccacuggggcugcuggugagguuuccucucugccuaguuaagguaucuuccuaucaccucucaacugaaucaccuuuucccucagggcugcguucacuccccauaaagcauaacuucauagcacuaugcuccuuucuuuugaagcacuugccccaguuuuaaaaacauagcuccaugauucuuuaauggaaacacucaccuugacaguguuuuaagcuauacauuccagaagggcaaagaucacaccuuuuaaaaagucaaucauuuuaucucuagcgccugcccugacacuaaggauuuaaaaaaaaauaguaauaaugaaaggauggaaauagacaauggcaauaagacccucgagaaauuugaauuggaaaagccuuuugguauuuuuaggucuagagaaaugugguggauaugaguuagauaugauauuauuaauaccacugcuacuccaagcuucaaugauagucaugauauuuucuaauguuuuugaagcauuuaccacuaugagucaggcaggguacccagcuacucaaugucauuuaguauuccuaacagcacccuaggguagggacaagaccauuaauauuuuguagaugacaaaaucgagccucaaaagaaguuuagcaacaugccaagggcacccaacucuuuugggaaagccagaauuuucacuagccauugacgaccaagcucuguuacuaaaucauaaucuauaacugccuaucauacuccacccaaguuuuaccuagaaucagagaauuuuuaaucucuagacauuccaguuggguaaauacaacuauugccacuugacugcaagggaagucaaaagguuaaucaacuuacuguguuugccguaaagggaaauuugaaauaucagcagaaagaaauuuaucaauauggcuucaaacugcuguaaauuuaaaacagaucacagccuuucuacaaaaaauaugacugcacuucagcauaaagccauuuaaaaauaacuauuuccagauaccauauggguuaugaaccaguuucacaugaguaguauaauuuuugaaggaagucguuauuagaaacacaaggcugaaaaaucauuuuagaccaaaacuacaggaaauauuugaagguagguaucuuaaucgaaaaacaaauguugaagcuggucaagagaaaaccugcagagaggaaguucaaaauuccagcagacaggggaaauccaaauuccaagaaggcauguaagauauggagauuguuuuguaaaacacagagaccaggugaauuccaaaaacauuacuguugucagagagcugcacauuaaacgcuauuccagcuuuguucacuaaacaagugccagucuucauugccuuuuuuuuuuuuuuuaauuuuuugagacacagucucacccugucucccaggcugcagugcaguggcacaaucuuggcucacugcaaccucugcccccuggauucaagcgauucucuugccucagccuccugaguagcugggauuacaggcgcccgccaccacgccuggcuaauuuuuuuguauuuuuaguagagcuaagguuucaccauguuggccaggcuggucucgaacuccugaccuaaggugauccaccugccucagccucccaaagugcuggaauuuuaggcgugagccaccacggccggccuggauugcuuucuaggagacccauacugucccaaaucuaacacaauuauuucuacauguagaguaaagaaaaaauagcuuuagaaucuaaguuagacaugggaaagaagaaaaaucaacuguguagaaaggagaaacuuuguguauuuauuccuacauaagugaaauacacuguauacaaaagaagggcagaguccucauuuuuccaaguuucccaaguacaaauauaaaggauguuagacuucccacaggccauggcuauaauguuaaaaugcuauaauuaauauaacuuuuccacugcaaacauuuucauuaucauucagcagauguuauauuaaaagaaagaaauaacuccaugcuaaagggaaugcucuucuuuuugacaaguuuaaugguuucuucuuaacuagauaguuauguaggucucauagaauuuggagucauuaacacagugauguuaaucuauuccaagaacugaguaaaacugcccacuauacagagcaugagaagaaaauaggauuuauacaaaaaaagagaaaauguugauauuuaggaugauugcaaacugguagcagacaugugcuuuguuuugcccaugcagagcuuacaaaaaauguugaguaaguugcccacauuaaacauuggaagauuucacaucauauccagauguuggcuugucuggaaaacucaaagcaggcaacacuuggaccuugauccugaaaaacugaagacaguaagcaccuucccuacugagauguagccuccugucccugucugccacaggguccucuguguuguccuauguacagcaaaauugcuuuaccuacuuguguauccucccugaccuuaggauuugaguuugggacacccaauauaaaggaugguaaggguaagaaaucaggaagaaguaaucuaaagaagaggaagggccgggcaugguggcucacaccuauaaucccagcacuuugggaggccgaggcaggcagaucaccugagguuaggaguucaagaccagccuggccaacaugaugaaauaucgucucuacuaaaaauacaaaaauuagccggauguggugaugcaugccuguaaucccagcugcuugggagccugaggcagaagaaucacuugaaccugagaggcagagguugcagugagccaagaucacgccacugcacuacagccugagaaacagagagacacucugucucaaaaacaacaacaacaacaacaacaacaacaaaaauaaauaaagagagaaagagaaagagagagagaagagcaggaaccccagggagugguauaacaaucacacacgacagagaaacggagggcuuccagaaggcagugaucaaagcugccagacacuucagaaaagucagauaaccuaaagccugagagcaacccaccaccuuugcaacgaggaggcugugauaacuuugguaacgaccauuuuaaggcauuggucuagaucacgguuucucagucucugcacuguugacauuuugggucagguaagucuuugcuguuggggguugggggcugucagugcauucauuacaggaaguuuagcagcauuccuggccucuacccacuugaugaccuuaguacacaccccgaaauaugauaaccuaaaauaacucuagccacugcugaauacccccugggguacaaaauucuccaugguugacagcuacuguuguagguagaaaacagaugaaacuguguuaagaaguguaaguuuaagaccuaaagagagagaagacugaaaauaugcaccuagauguuugggugggaugagaaaaaccgucauaggguagcugcugcagggagauguugaaaauacaaaaaauaauuuacuuagguauguagaaauagaacugacaugauccuguucaguggccaucagcauccugaccugacugcuaucuuuucuugcaggccaaaaggaacaauccuuugugggaaaugccucccaccccacuuucauuccaugugauucagcuagaagcuagacccaccaccaggugugggggaugccacuuuacucaggcuuagagaugaggcuaucucaaucccagccaaggcaccagcgcugugcacauugcugucuuuggucugaaacuguuaacugauagguaguaaggcuagguaccacuucaggcagugggggauggugaggaugaagcagacaaggaggaaaguaggccagagagauggagagacaccaaguccuucugacaucacuuagcaccucaaucccccagaguuagaacuagacacuucuuuuucacuuaaauucaggugaaugaagcauuuaucucuuaaaagaaagccucagagaagcuagaggaguucugacuuaaguuuuuauguuguuguuucccuacccuagaagauaaaacuaagugaugucuuuuguuucuuuucauuaagagacucuacuacuacuugcuaguauuaggguucuagaaaguugcuuaaucacccugaccuuuugcuguuucaaucgagaaauggagaagaaaacacuauacacuucauagaguugucuggggcugcaaguaauaugcugccgagcacaaaguaguaaaaugccuugguuacacuaagcauucaaaacaugucaauagcuacuauucaggaugcaaccaugacuuauauucaggaugcaaccaugacuugauuaccacuacugcugcugcuacuaccacuccuacuaaugaugauauuuacaacuauaacuguaaugucccuaaguaauagucucuaguauaaacuaauuacagauagcuuugucuguacaaucuggaauccuauaggagucuaucuuuaggaagagaguggcuuauaugaacaucuugccagguaugggcucuuuaaaauaagcaaaaaggcuuucaaggaucaagaacucuaugguggcacugguuaaucaacgccccauagccagauaucucaaauaagcuaauacaauuuaaaauggaaucucugacccugcauacuugaaaaucuaccccccaauuuggggucucauagaagaccuccauggucuuauacccauucccuauaggcuccucacaucucagcuccagcugcaguagacaguucaggcuaagcucagccuugccuccagcagaccacaucccaccuagagccagcauuacauaucuucgcaccuguuccccaugcuuuucuucuaucccagagucuacuuagccuccagccauccuuuggggauggagugaguuaagaccccugggacuaccccugauuaauggaggguagaacccagugaacauccuauuucagggggaauugugugugugugugugugugugugugugugucuguguguguguguguguguguguguuuuguuuuuuuuuuuuuugagacggagucucgcucugucgcccaggcuggagcgcaguggugcaaucucagcucacugcaagcuccgccucccggguucacgccauucuccugccucagccuccuaaguagcugggacuacaggcgcccgucaccgcacccggcuaauuuuuuguauuuuuaguagagacaggguuucaccguggucucgaucuccugaccucgugauccgccugccucggccucccaaagugcugggauuacaggagugagccaccacgccuggccucucugugguucuuaagagauuauggcagaauuuaacucacagugcccucagaagaauccucuagaaagcauucuuauacugcuguuguuccuuccuuaucucauucucucugucugcucacuucugcuuccugggaucaccucccaaauaaacuaccugcacccaaaauucuuaucucaggcucuauuuugaaagaaaccaaauugccaggcaugguggcucaggccuguaauucuagcacuuugggaggcugagguggguggaucaccugaggucaggaguuugagaccagccuggccaacauggagaaaccacgucucuacuaaaaauacaaaauuagccaggcgugguggcgggugccuauaauaccagcuacucaggagucugaggcaggagaauugcuugaacccagggacagagguugcggugagccgagaucauaccacuucacuccagccugggcaaaacagcuaaacuccaucucaaaacaacaacaauaacaacaacaacaaaagaaagaaagaaaccaaauuguaacauaaaucaagccacaauaauccaagauaauagcaaauauguuuacuguguacuagaugccauuuucagaccuuuacugaaauuaauucaucauuccuuugaaauggaugauauuacugauuccauuucagagauauagaaaggaaggcacagaacauuuaaauaauuugcccaaaucccacagucaccaaauggugaagccagguuuggaauucuggcugcagagccucagucacuguaguaugcucuccaucucuacacuagaauugacaaguucugugugaagaugaacuuuauguaucaaauugacugggcuaagggauucucagauagcugguaaauguuauuucugggugugucuaugagggcauuuaaggaagagaaagcaugggaaucaguagacuaaagaggauucacccucacugacacagagaagcaucaucuaauuucuugagggucuagacagaacgaaaaugaagaggaaggaugaauuugaucucucucucgcucucuuuucuugagcaaggauauccaucuucuucugcccuaggacauccacacuccagguucuuggacuucuguaguuuaggacuuacaucagcagcccccacauucucaggcugucagccuuggaguaagaguuacaccuuuggcucccuuggguuucagguguucggacucaggucaaaucacaucacuaucuuuucugguucucuaguuugcagacagcauauuguggaaauuuucagcuuccauaguggcacgagccaaucccuauaauaaguucccuagcuaccuaccuaccuaauuguauguccuauggguucuguuuuucuacggaacgcugacuaauacacucggucuccuucuagaaccguugcaaacacacagguauacaaagaacuuuaguuauauaaugagauacucaauuuccuaaguuuccugcugcagcacaaaauaugacccaucacuugcuuccugcccagugaaaggaauauuccacuggcagauguccagucccuccaccucugagcacuccuguccucuucuggaagcaggccuaggggccagcaaugucuguuaucccgauaguccuggaacacccuucuacguguguuagguucuaacauagagagggcuuuuccaggcuccugcaaaucccuggguggggccuggagcauuugagguugagaaggaaaaaacugaaucuacuuguaagcgguggccgagaucacuaauggggauuucaacucugcgagcaaauuuaagucccacauuuaggcagaauguaaauaacuuuuaaaaauaacuuuaaguagaagauuuauuuacaugccuucccuucccucauuugaucaacuugaauaauuaaagacuaaugauagaaaauacauuuucacaaaacaaagugaaggcuggaugagcacuguuggccuccaaaaagcaaaguuuugacuuccaggucucaucuuuacaaaauuauucuaacucucugccuuuuuaaaagguaccuggcucaagaccaagaacuccagccaagguugaaugcccugaauuuuuuaccuuuguguccagcuuccucaugggaaaugccccaaaugucacugaaacacaaccucucucaaauacacauggagcaacugccggacagcaaucacauggugauacauuauuaauaauuuuucaccauuaccauaaauuacaacaaacaguagccacuauauuaaccgcuuauuaugugccaaguacuguuuaaacauuuguacuuguguuaaugcaauuucauacucacuauaacgaugugacagauaauaaugucaaauuuguaguuaaggcaacugaugcacaaagaggucaaaugacuuacccagggucauauagauaagugggaaagaaaauaauuaauuauuaagaaaguguuaguaccauuaguccagaaagaauuuuuuuauccuuaggcuaauuguuaauaauaacgaccagcacuuauugagcauccuuuaagucaccucauuuaauccacauaaugaaauuuggagguaggcaguaugaagaguaagcaacuuucucaaugucacaacaauuuuaucaaguggcagagccaguauuugaacucaagauuaucuauccucagacucugugcuucuaacucacuacacaucccacuaugauaugacaugaaaagauagaaaaucagagaaugggaggagagaagguuuagggaccaauguaguuaaaagucaauaguaauaguucccugcccucugaauaucucugccccucugccuggaauagagccuguugauggcuuagucagguccucugaacaacaucuaaaugaccugugugucucagccaguuuacuaucuguuaggggagacugagucauucauucauucaaaauagauauguugaauauucauauacaucagagaugcugggaaaaaucagacacagcccuccucacagcacuuacagucuagugagagacaaauaaccaaggaaucacacaauuucaaauaaguaacuugaaaggaagggacacgaugccaugcaaguacaaaacaaagggacuugagugaaucuaguuggagaagaggguuggcugggaaggaaggcuuuccuaagagugugaccuuggagcagagaucugaaugacaauuggaguuuuaaacuggaagcaacccacccuuccucccucccucccucccucccucccuaccguccucccuuccucccuuccucccuuuuccucugcuuucugcagaguacaauaugaaaauucuucagaagguaauucuugugaaacaaaaagcuuugcccuuuaaagacaacugugucuccuaacaggaggaagaggaggagguggaggagcaaaaaaacgugaaugaauaaaucaagagcuugaacugacuucugcauuucugcuaaaacaauuaucaaacuccacaagccaauagaugccuaugaccaaagggaagguggaacuuuucagggcaacaagcaaauagauuuggaggauaccuuuucagggucacaaaaaauuagauuuaggggggaaacagauuuugagugcaaaccucaauuccacuguacuauauaaucauacauaccuaggauuucucuauaaguucuucucuauaagucugcagaaccaauggccauaauaaaauuacaagaaagaagaaaggaaaucuuagaaaauuuacuauggggcuaaaugucaucuaagaaucaacacuggaaauaagagcaaacauaauuugacucucaaauacauaguagauggaguaguuaacagugcuggacuguuuugucuguucuguuuguguaaugaaaggauauaacuucccuaaacccaaaccacgucauucuguccaucuuguuuucuaauguauuucucacagagugcacucugugauccuuugcgucuaaggugacugauucuaugcuaggcucugaagcugcaaagaugagaauaaucacucucuauccucaagaaguuccuuaucuacuaggaagauggccaaguaaacugguaacugcagugcagcaugaugacaaagauaagccccaagagcucaaagcaugaauccuuaacacagucugggaguaucacagaagaauuuuugcugaaaaggauguuugaacagugucuuaauuaacaaggccagagcccccagagcgggggaauguuuuuagcacugcuguuaauuaccuuagccacuggugaggaaaaaauucagagugauuuugggcagaucagcucugacuaaaggugacauuaaaauccagacaaagggagcauuugucuugaagcagcacuuggccaccccugggcugggacugggagagaaaauguggacuccucagacacauguugacagcuaaguggauccaaauucauguccagacagggagcucauggucaacugcauucaaaauuuuucaauccugaaugaaaaucaaacugaaacagcagaauccuuuucaauaccucgagcaccuuuccaucccacuugggagaacagcuugcaauguccaauccugcauccaauucagcucucauuuugaucaucaauaggacagauuuauuguaaugcuuugaaugagcagauggccuguagucaaguuucaacucaauuugauguugaggacauaaaccuuaggaaaugaucccuuccuguguguucuuaauuucaacuuuuccuaagugagaaagcaguauuaagccuacaaaaguuauuccucugcuuuaauagaugggagaucuugagugauuaaccucuuguauugucugccaggacuuuccuaacaaaauaccauacaccauguggcuuauacaacagaaaguuauuuucuuacaguucuggaggcuaaaaagucuaauaucgaagcucuggccacuaugguuccugaugagggcugacuuccuagguuacagauggucaccuuuucacuguuuccucacaugguagagaaggagaucucugguaucucucccucuucuuauaaagacacacugguccuaucagauuagagccccuucuuuaugaccucauuuaaccuucacuacacucucacagauccuacuuccaaauauaucaggguuggaagaugagaaagugacgaucuaauaaucuauguaagaaaaugaaagaaauauuaaacccaaagcaagcaguagaaaaaaaauccacauuuuucaauucacuuuaugaagguagucuaacuuugauacccaaaccugacaaggguacaacaguaaaauuacagaccaaauuuucucacaaacauacagaugugaaaucuuaaaaauuuacaaaugaaaucuagcaaugacuaaaagugacacuacaucauaaccaaguaaguuuuauaccagaaagccaaagcuggcuuaacauuuggaaaaccaauccauuuacugaggaaaaaaagagaaaaaucauauggucaaaauagaugcugaaaauauaauguauagguauaaauuauuagagaauuacaaauaaaagguguuaucaucaaucugauagaggguaucucaaaagaaacccacaguuaacaucauguauaauagugaaauaaaaucuugcccuccaagaucacgauugaaacaaagaugcuugcuuuuaucacuuguaauuaucaccacacuugagguccuugacacuacaauaaacaauaaauaaauaaacaaauaaauccaugaagauugggggaaggggaggacugucauuauucauaggaaacaugauuguauauuaagaaaacugaaaagaauuuauaacauuaccagguauauacccaaaggaaaauaaaucauucuaccaaaaagacacacgcacucauauguucaucacggcacuauacacaauagcaaagacgcagaaucaaccuaaaagcccaucaauagugaacuggacaaauaaaauuuuguacauacacacacagccauaaaaaagaauaucauuuuuuuugcagcaacaugaaugcaacuggacaccauuauccuaagcaaauuaacaaagaaacagaaagccaaauacugcauguucucacaagggggagcuaaacauuggguauauauggauauaaaguaggaaaauuagacacuggggauuacuagaagggagaggaagggagaagagaaagggcugaaaaacuaccuauuggguacucugcucacuaccugggugacaggauuauucauaccccagaccucaacaucaugcaaaacacucauguaacaaaccugcacauauauaccuccugaaucuaaauaaaaauugaagagaaaggaauuuauaaguaaacuucuacaauugauaagugagaguguucuuaauaagagucuauauacaaaaaucaacuuuauuuauaccuaucuguagcagaaaauuagaaaauaaauacaauuauuccauuuuaaauagcauaaaaauaucaaacaggcacgaauaacaaucuaagaaugagcaagaucucuauaaugaaaacuacaaaacaccacugaaaagaauuuaagacuuaaccaaauuagauguaccauguucauagacggaaaagcaauaacauaaauauuagccuguaaauucaaugcaguccaaauaaauaccccagcagaauuuugguagaaauuggcaaacuaacgcuaaaaugcaaagaacacaauauagucacgacaauccaaaaguacaaagaugagggacuuauacuccuaaauacguguaagacauguuacaaagcuaccauaauuaauaaggugugguauuagaauaaagacuuuuuuaaaaagugaaauaaaauacagaacucagaaacaaaccaacacauacacaaucaccuaugacaaguaucagcuagcaauguagugugccuguagugucuuucugauaaaaugcuguaucaggugaauuuccaauugggagaaaaugguagcuagaccugcauuuccuaucauccaaaaacucaauuccaagcagauuauaaacuaaauguaaaggcaaauaaauauaacuuauagaauuuuacauuggaaaauauuuucaugaucuuggauguaagaaagcauuuuaauacaggaagccagagacugauaaauugcgagaaauuaaaauuuaaaaagugauucauuauuaaaaagccauuaaaaggauaaaaaggcauaccaggauguacaagaaaauacuauuauccaaagagaugccauacccagaaaaaucuaauagaaaaauggcaaaaaacuuagggagauauuugacaaaagaggauaucuaaauguccaguaaaugugaaaaauuugcucaacuucuuuagucaucagagagacacagauuuacuauaugauauaccaagcauacucuagauuaaacuuuaaaaacacaaaaauaccaaguacuggcaaagaugaggaacauguggaacuuguguggagaguuugugggaauguaaauugguagaaccacuucagaaaacugacauuuucuaccgaagcugaauuugcacaugcuagaugaccgagaaauuccauuucuagauaaauauagccaacagaaaugaguacauuugaaccauaagaccugcaaaaagaauagucacaacagcauuauuuguaauauccccaaaccagaaacaacccaaaugucugucaacaaaaaaauagauaaauagugguuuauucaugaggugagauacuuugaagaaacgagaauaaacuacagcuacauauaacaauauggauggauauuaugaacauacuguugagcaaaagaaacucgacaaauuagagaauuagagcacucuauugauugcauguauacaaaguucaaaaaaaggcaaaacuaaccuucagugacagaagucaugguagcaauuaugucuguggagugagacaauuuggaacugagagaagguaugagugaaggcuuuugcaaugauggugacaugauauauuuucaucugguuggugguuagaggaguguggccacuuucugaaaaucaauuagcuguauacaacaguuccuccuuaaccacauuucacucuccaugguuucaguuacucaaagucaaccacagucuuaaaauagaugaguaauuauaagauacauugagagaaaggccauagucacauaacuuuuaauacaguauauguuacacuuguucuauuuuauuauuauugauaaucucuuacugugccuaauuuauguuaaacuuuaucauaaguauguguauauauauacacacauauauauaaaaauaaagaaaaaacaguuuaauauugggugcaguaccaucugcaguuucaggcauccaccggagguacuggaacguauccucugaggauaaugggagggcuacguacucauuauuuguguaccuuucuaaacauauaugcuauuuccauuaauuauuuuuaaagcagaaacugaaauauucuucaaaggagagaaagcgguauguaggauugcagaagcaccuugcaaacuaaguggccacauuuuagucaaaaccuuuagacuaaagcuacauugccugaagccuuguccuacgaaacagacaccgaagaaaauagagauaagaaacugcauuagugucaaaaguagcauuuaacuggggacuggcuuauuccacagagaauaacaaaaaacuguucuccuaagcugauaugacaggauaaauaguaucacagacauucugcucgcaguagcugacucaacagccaaggcugacagauuuacaauggagaacugaauccugagaucaaaaaccaugugcucuguucggggcuugaugaccuacaguauacacugaaacccuuaaaucaacagguuuauggcauuuauggugaaccacucugacgggucugcuucaucaaacaagccuugucuugaaucucagcucagcuaaaagcuaggcuaucaaaggcaagcauuuacuaacaugggaggaaaaaugcuccauuuugguucaaaugcuuaauagaaaucuuucuugugcuuuuggaguaaagaaaaaaaaaggcaccaauguauagagacguuuauaaucuuuaagaccuauagugcuagaaaagauuuauucggugauuccauaccuccugcuaauauuaccguacuagaauucucaguauuugucugggugggaucaaauugacucacccgauacuacuuaccugggggacaauuacauauaggacuguauagaucuauuaaauuuugaugcucuauaauagugucucaaacuauuuugacuaaaagccauggcuaagaauuaccacacacacccacacacauuuuauaacauggcucagugcacaaacacacuacaaaguuuuacgaauacccauucuuccuagauauuauacaaucagauguagucucuucuauuuuauguuacucuaugauauuuucuuucuuauuaauguuggucauaaccaacugaauugauuuaugacccaagaauugguugcaacccaaauuugaaaaaaaaaaaaaaauuccuacaaagaaucaaaaauguuuaaauguaugacuaggccucaucuuuuuuaaaaaauuucacugauucucaaaauuuggugagcaugaggauccucuagcaugcuuauugaaaauacagauucaacagaucuggaauggggccuaggaaucugaauuuuuaucaagcacuccaaauaaggccuauggagguacacuaaagauggcaguuugagaacugcaucccuaauccuaucuucaaaugaguaaacugaagccuagaaacgggaaauaauuugcacaagaacacaauauuuguugaguccugggacuaaaaccaagucucucgaccccccuaccaucuuggcagguagccagagaccgcccuugcuuguuguaaucccugcugagaaaccgaugguauaagaacaauaaaauugagcauuagaaaggagaaacuaauaacacuggaugucccuuuucagaaaugagcuggacccagacccaggacugaguacagguagcugggaaccccuucuagcacccagccaauauggcaacagaaaugcauuuagugcgacaaaucauucuaaaaccuuccuuuuuaucaucaaacuucacaguguggcaaaaaauauaacauucuggccuuucagauacucccuguuuauucacuaguuuuggaagaccauuacaucuuuuccauuggcucacuuauuccaacugaaacccucauuuucccgcaaaugccaaugaaacaugaauaucaacugacuaccuguuuuaggugaugaguggaacagaguaguauggcagcaaugauuuauugugaugcuugaugcuuauugaguauuuggguuccuggaguauaccaaucauuccaccuugccacagggcauucauacucgcugccauccugcuggggugcucuuccugaucauagccacauggcuggcucccugacauauauauaucucccggucucugucaauucaucagcaagaccuuuccuggcauucuguaugaaagaacaugcuggagucagucucaugccaacgccuuuuugcaggaccacuagggccauauugcuuucuggauacucucugguuggaccugcuuggcgcuugagacauauuucaugagucaguagauagacuuggacuuuaaaaauauuuaauaauagaucauuauuuuggaguucauacacucaugacacuagccaucuaguacaggagacaggcauuauucaaauaagcacaugacuaaaugugaaaacacaauuggaguguguuaugaagaggugcaaagucaacuuuaccauugaauggugaaaaggccuugugaugguuaauuuuauuugucaacuugauggaccacagaguauccagaauuuuuuuuuuuuuuuuuuuuuuuuuuugagacagagucuugcccugucaccugggcuggagugcaguggcgcaaucuuggcucacugcaaccucugccucucaggcucaagcgauucuccugucucagccuccugaguagcugggauuauaggugcccaccaccaagcccagcuaauuuuuugguauuuuuaauagagacgggguuucaccauguuggccaggauggucuugaacuccugaccucguguuucaccugccuuagccucccaaaagcacugggauuacaggcaggagccaccgagcccagccagugcccaaagauuuaagcaucauucugggugugucugugaggguguuuccaggugaaacagacauuugauucaguagacugaguaaagcagauggcccuccccaaugggucucauucauccaccaggugggucucauucauccacugaaggccuaaauagaacaaaaagacugaguaaggaagaaucccucugucucugagcugggauaugcaucuucugcugccuucuaacucagacuguaacucguaccauuggcuuuucugggucuccaucuucucaacgagucuugggacuucucagucuuuauaacgcaugagucaaauaauauuauaauaguauaauaaauuucuuuuuuugagacagggucucgcuguaacucaggcuagaguacaguggcacuaucauacucacggcagccugcaauucauggacucaagcgauccuccugccucagccuaccaaguagcuaguacuacagaaguaugccaccauacccagcugauuuauuucuuucauguauuauagagaugggguguauuagucuguuuucauuuugcuaauaaagacauacccaacacagggcaauuuauaaaagaaaagaaguuuaaggggcucacaguuccacauggcugagaaggucucacaaucaugguggaaggugaaacgcacgucuuacauggcagcaggcaagagagaaugagaaccaauggaaagggaaaaccccuuaugaaaccaucagaucacaugagacuuauucacuaccacaagaacaguaugggugaaaaugcccccaugauucaauuaucucccaccaggucccucccacaacacauagaaauuaugggagcuacaguucaaggugagauuuggguggggauacagccaaaccauaucacagggucucacuauguugcccaggcuggucuugaacuccugguuucaagcaaugcucccgccuccgucuuugaaagcucugugauugcaagcaugagacaccaugccuggcccuuauaaugcauuucuuuacacacucacacacacauauacauuuauauguauaaaaaaaaacuuguugguucuguuuccaugcagaauucuggcuaauaugcacccauucaugcucauccuagcaacaagaauagacagaggagucacaccugaagagcacccacugcuauuucccuaaacugauaauucuuucuguagaauaaaggccaccugaccugcuccucauuucaaguauuccugagaaaacccuccccuacuuuuugggccuaaggaaaccaggacucagcaagggaauaaaacauuaaaacuaaagacaggcucuaacucuccagcuauggaagaaaccaccucuaggguagagugcagaaaaaccuuacuccuggggugacuucuccugccuuucuguggaaauuaucugcuucagugcuagcauugccaccagcaaggaaaauuuguucaaauccauuugaguagaaauacagguuaacuaaaauuucugauacacuaaaugugaccucaagucagauacaauuuauuuuugaaugcccacugcucugaauuauuuuugucacucaaccccucuauuagggagggaaauuuauaauagugggacauuggguuuuaauuuccugaccauggauauuuuuaaaacuauaauugcuuugcuuucuacauauguuauuuaguauacuuaaauauguuauuuaguauacuuaaauauguuauuuaguauagcuauuuaguauaacuaagaaaguuauuacaaaaacaaaccauaaggcugacacuuaauaaagagguuuccaucugaaaaaaaaaaaaagcaaaaguuaauuaaacuagcaaguuuuaaccaaacauaauuagaagaaaaucaacauguacguucugaaaauguucagaacauggccuauuucauuuaucuucaaaagaaacauuuaauuuagucucuauuuuaaauucaguuuuugccaucagaauuguacaguuuucuauacaacuacauagaaauaugaugacauagaaauuucugcauagaaacuauaugacccauauaaugggugcauauuagccagaauucugcagagaaacagaaccaacguaaguauauaauggccaagugccuccaaaccaaaauaucaaccuguccacaucagaguauucagcugaaaacugcauauucucugaaacuacuguuugaaggacaaacaauuuuagcaaaccagucaauacaaagggacuauuacucaaccuguuugcuuucacuguaucuguuagggaacuucaggguaggaaauggcuauaccuguacugcccaagacagcagcccuuaguggacacuugaaauguggcucgucugaacugaaagugcauuaaguauaaaaugcacacuggacucugaagacucaugugaaaaauaaaaguauuucauuaauuuuugccgauuauuauuuugaaauaccaguuuuaaggaauuggauuaaaauauaauaccaacauaaauuuucccuauuucuuuuugcuuuauuuuuuccuauggcuacuaaaaaauuuaaaauuauaucgguugacuugcauuauauuucuacuguacagcgcuagccugaagcaaagagaugguagaguuccacacaucacaaaaaagaaauaggagauuucaugggggaauaaaacaaacuucuguugucauuauuuaaaaauaaagaucuacugcauacuaaaauuagauucauucaaauaaacaucuucaaagacacaaaugaacugcauaugaagguugagcaaugguaauccaucaauaagaauucuugguuuacaucauuaccccacaugucaucauccaaacaaauaaaagaaaucaauuaaaaaugguuauagagugugaagucauccucuaagccaaccaugaagccucugucucccuccaacugcucagacaggcacauaaugugcucacuuguauuuacuacuuuaaaagcaucugcaguuauuguuggcagacacagagaggugaguaauaacaagacaacugacauagaaaguagugaaucaacaagaccaguaauguauccaagaugcacugugaggaacaaauauugacaaugcuagaugccauaauacucugugcugugggcacugcacccaauaaauguugauucaugaaguguguaggcaaauugcccauugcgucuaccugucagccaguauaugcucaaugcgcuuauugcacuaugcuugccugcuuccucuaugagacuaggagcucuuugcggaaagugucuauaacucauucauuucuaucauaguuuggacuuucauuucaaaaugucagaaaugaaaguuaaacuagauuaacagaaaaguggagagggguuuaugcauaagauacccacaguacuuuaauuucaggcauagcugcauaucaccacuaugaugacccuacucucagggggcaagaugguugccagcaacccugggauuaucuuccauccucuuugcuaaccccaggugucccagaauuugauuuuuauuggcaccgaucuuguugccuguuuauuucugaaccaacuacucuaggucaacgauaucugauguucugacuagucaguauguaaaacaugucaccuucccacagacugcauggacuugaggaagagguggggaggguagauccuuaaggaaagcuucaacguuaucagaugacuggaguaaugaaugcuggguaggcaaaaaaaaaaaaaaaaaucagagguggccacugucauuuuugaguccccacauaaaagacacgccauugauguuuuucccaauggaugaaaaaaugagaaauauccaauguaugaagcacuucaaacauagaaauaauuuaucuauuucuaaauugccaggauaauuacauacauucauguaacaaacguuugagugccuauuacuugccagggaugauuccagccacuggaaauacagcagugaauagcagagauaaagccucagcccucauggagcugauauucaagguggaaggcagaauaugcuaggcgauaaacaagugagucaagcacugggcaauaaauaauauaaagaaaauuacagcagagaaggggguuggggagugaugggagugucagggaagaccauucuggaaugacaguauuugcauagggaacugagggaagaaauaaucagauggauaccugggggaagagcauuccaagugcagucacugagguaggacaucuggggauguugaaaggcaguggagcccaguggaagagcucaguggcaugcacaauaauggaagagauaggaaguuagauccaagggacuuuguaggccaugguaagaaaucuggauuauauacugauacgguugggcuaugucccuacccaaaugucaccuugaauuguaauaauccccacaugucaagggcagggccagguggagauaacugaaucaugggggugguuuuccccauacuguucucaugguagugaguaagacucaggagaucugaugguuuuauaaaugggaguuccccugcacaagcucucuugccugccaccauguaagaugugcuuuugcuucuccuuugccuucagccaugauugugagaccucuccaggcaucuggaacugugaauccauuaaaccucuuuccuuuauaaauuacccagucuuggguaauuugucuauuagcagcaugagaacagacugauacauauacuaugcucaauguaaagccaugagcugguagagaagaggaaaaugaagucaucucaccacuaugagaagaauagacuaaagggacagaagagaugaaagagucauuagagaagaagcugcuacaggaauccaggugagagaugagaaugauuuagaacagugauggcagcagugguaagaaguggucagaauugcgcauguuuuuaacugaccugggagcaaugaaguuuacauggccuugagcauaagauuacucgguauuuauauaucaugaagggcacagaggcaguugcuuacauugcuugcccuuuaaaaaucagucucaucacuuauuuguguucccaggguccuuugcacauaccuuaacuguaauauuaauuuuguugcagcauccuuaugacaucauuacugcucacccucacauugaaauguccaagaauuuaggaaucaaacuaucauuuuggcauucuuauagucugucauaaugugaagacauacaguaggcugagaaaaauguuuuagaagugugaaugggaggauagguggguggguggauagcugggugggugaguggguguguggguggauggaugggagaauggaagaaggcauagagggaaaagaaaaagaaaugucaaguuguuaguuacuggcagcuagaaacacaagcccaaagugacuuugacuuugcuuaccuuauauauuuauaaagauauugagaaauuuagaacaugcugcuaauuauauaaaugccaguguacuacucacuguuagcugaugggucuauucaacgaagggacggcagagaaagguuaaaugauuaggucagcuggugagucuaugcagauggaagaauuagguuccacaucuaacaauccaauugcaaaagagcucuuugccucuucaaguauggcgacuauuuuuaaaagaacuaaaguguaaguggcauauguauacaugugccaugcuggugcgcugcacccacuaacucaucaucuagcacuaggcuaaaacuuaaaguauaauaauaaucaucaucauaauaaaaaaaguguaaguggcccaacuacauacaauagauagaaaaaccuaauacaccuuuccaagguucucaggcaagggcacacauuugcaaagcacaggaaacaucccuuauuucauuuucagaacagcucaucgcuccuauucuuacaggucaagagaauauagaggacauuuaacuuuggucuuaggucaacugcaaaagcccagaaacagaauccacauuucaaaucuacauccacgugguuaggccccuuuccucauaaaaaugcaagggugaauuuuauuauaaauacaucucuguuucuuuagagauccagucauuuucaggagucuggguugucaugcugugaaauucaaaagcaaauacacaucuauuaaaacauucccagauggguuuucugcugccauccaaucgacucccagcccacacacaccauucauacauagucucagcagcuaaguaccucaaacauagauuaccugaaaucauuauucauaaugacaaugaaauaaacagcagguuacucugaaaaaaauaaacucauauaagugcacugucguaaagaauagaguuugugauugugcucuaugaguaguucucagcuagggacaacugugcccccaggaaagauacuaggcuaugucuggagacauuuuuagcugacauaacuggggguugcuacuggaaucuaaaggguagagaggccuggaaugcugcuaaaccuccuacaaugcacagacaugcccugcacaagaaagaauuauccauccuaacaaaccaauaugucuccagacagcuucccccuagaaagaauuauccauucuaacacaucaccaaugcccgacugagaaacccugagcuaaacauaacaauuuccuaagcaauuuuaaauagugaauaucuaagaaaacuugcuucuucucuuugggcuuacugucuuacaagucauugacaggauaauuuaagauggccaugaaucugaaaaggggacuauuuggugaacaccugccaaagagugggcacuauagauauuuucuguauuuguuuucuauugcugccuaacaaauuaccacaaacucagcagcuuaaaaacacccaauuauucgccgagugcggcagcucacgccuguaaucccggcacuuugggagguccaggcagguggaucacaaggucaggaguucgagaucagccuggccaacguggugaaacaccgucucuacuaaaaauacaaaaauuagcugggcacgguggcaggagccuguaaucccagcuacucagaaggcugagacaggagaaaugcuugaauccaggaggcggagacugcagugagccaagaucaugccacugcacuccagccuggaugacagagcuagacuccaucucagggggaaaaaaaaucaauuauuaacucccaguuguguaagucugaaguguggguacagugugacuguguucccugcuuagggucuucaggaugucacccaggcuacauuccuuuuuggaggcuccaagaaagauuccacugcuaagcucacucaggcuguuggcagaauucacuucccucugguuguaggacugaagcccccuuucccugcugucagcuagaggucacucagcucucugacacccccuucucaccccuagagccccaugugccuugugucauggccucuuccaucuccaaaguccacaauggagaauuucucauaugcuaaaccccucuagcuaugaaccucucugacuucuucuccucucuuugaccucuggacccaaucaaauuuaaagggaucacguaauuaggucagaccuaccuggaaaaucuuccuaucuuaaaguuaaccaaucugcagucaugguuacaucugcaaaaacuccuucccagaaauagacugaauacuuggagaaagugucgguacacugggagccagcaauuuugggggcugucuuagaagcugaccucgccaggugcggugacucaugccuguaaucccagcacuuugacaggcaggugaaucaugaggucaggaguucgagaccagccuggccaacauggugaaaccccgucucuacuaaaaauagaaaaaauuagcuggguaugguaguggcgccuguaaucccagcuacuugggaggccgaggcaggagaauugcuugaacccaggaggcggagguugcaguaaaccgcaucacgccacugcacuccagcccgggcaacagugugagacucugucgcagauuaaaaaaaaaaaaaaaaaaaaagacaucgaccuccuacauuuuagacacauuaucucaauucucacaacaccccuucgaagccuuuuuuucuuccaucuccacuuuacagacgagcaaacuagauucucagacaauuugauaauuucccaaaggugggugaaggguauguggaaacucucugcauacaugcugcaacuaguaagucuaauuauuucaaaauaauaugucuucaaaaagucauuucuccaagaucaaauaacuagcauuugaacauaccauccugccauguuaagcugugacaccaccaugucuaagaugauugcaucucuaaagcccguaacauuuaccuagcccaggguuucucaaacucaacugugcauuaggacuacccuggggagucuuuaaaauaacacagauguuugggccccauccucagacauucugcucuaauuguucuggggugagaccugagcauaagcgucuguguuuuuuaaagcuccgugcacuaagaaucacuguucuagacuuaugugcuagucauacacaccgagguuaaauauguaauacuaaacagacauuuguuguuucacacacaaaagaaacuuuuuacaaggacggaauucauccuacuucaaugcauuuuacuggaaaacaaugacaaaaggaaaacccugugacaagauguagagauauucauuagcauauuuaaagagugaaaguauauugugguaauauuuuuuucccauuaugucucuucacagcauaaaacacguagacucaauaauuaaggcagggggaagaaaagacugcaugcaguauuuacccacagaaaauuaauuuugaguaacacuucauuuaccuccuagaagaggcaaaguuaaauagaaaaaggagaugaggaauuguaaaaucacagggugaacccauagacacuaaaaaguacucuguuauagcagaacucgguaaaucagcagaaagauaaucuccuuuuaccagcuuaucucaaucccuuucaagugccgucucucaaauaagggugugcacauagcugacuuguaguaaauuagugaugugcacuacauaauuuauauuagaaagcaugcccccuugacuuguagugguaauaaggggcagauaaaauauucccaagcucagcagcaugaaaaagcaaucaaaggaauucagcugaaaacgaaauccuuagauacaucaaaagcaucccuucaggagaggugagcuugcuguccagacagaacacucucaccagacuugcauuaugguauuugaguguauuuugcccuguaauuggauagaaaaccgugggaacgggcuuucaugggaaaaacuugaugugacugaagaggaacuccuggguuuguucacagagacguguacaaaguccaagcaaauguuuuuggucaugaaagccuuagugcuaucauuaggccuguuuauauuuagacuucagauauuuaucaguaccacuuucucuuaaacuguuuauugcugauggugggaaaccacgcaauuucacccacauuuagggucuucuggagagaacuuucuaaggcacugcccuaggcucauggaaaacaaggaugaaaugaguucucaguaacuuugcauguuauacaagccagguauuaaugauggugauacuggguggcuaauaucacuguugguaagccauaucuggcuauagcugaugucccauauguauuugacaugucagcuuuucacaaaguaggucucucucucccuacccuccucauaaaauauacaauugcaugcaacuaagaagugucauauaucuccauguuauuuuucagcagcaucacaaaaaaauccuggaaauaaacauuaaucagaagaaaauaaauaugcaguaauuaaaagaauaagauagaucuauacaaaaaauagaucuaugcaaaaaaaccuccaaaauauacauuguuuuuaauuaaucccucuucccccaccaaacaagauguuuggcuaaugcaauuuauguauguuuuaaccacacacacaacuuccagaaauaauaagcucugguuucaugaagaguguccagccaaaaacuaugcagcccucaguuugcuaugcaucguuccagaccugcuucugugcauuaauucacagaccaauccauaaauaaaaauaugguuuagucuuguuuggauacagagacaaauuuaaugugguccacugaggcccgcagacaggugagagaccauauaaagcucucagccccacauacuucuucucagguauuauauaggguccaccuguggaguuauugcugaauaagucaccgcagaugccagguacccaaggaaguguugaaaucuucaucucagguggccacacaugcagaaggaagccaagcagaagcaagaagagccaagagaaagacaacaguggugacaucauuggauagcuuggaucuagccuuguugaaagcuagccaauccuaguacaagggaggaaggaagagaugcagggagauggggagggagggaagagaggagagugaaaaaaaaagaggaaggaagggagggagaaagaaaggaaggagguagggaggaaggaaaagaagaaaggagagaaaaaaggaggaagaagggaagaaaggaaagaagaaaggagggagggauagaggaaggaaaggaugaauuaggaagauuauuccagagccaaaaaaaugcauauuuuuuuaugcuuaacauagccugagaugaaguuuucuacuuacuacugaaagucuuacaauauauaaacaagaacaaucucuacauuuugauucacacuagccaccccacuucccuccuuagaauaccuaccagguaaugcuagucugugcauugacagucacacuuacauggugugaugcauuccacaaagcaaaaacaacucucccagagagguucaggcagucucguuuccacugaagguccuguucagacaccuugaggacaaugacucugagucccccauaggugaagcuuuucuuuccuuuauuaaacuugaaucccuaggcucuacccaggaccuacugaauguucagaggugggacccacacauauuuuucuuuucaagugcucagguccuuuugaagugccuuacuaaaaaauauccuacaccucagacguuaacuacuuauaacgccagcuugcaguuaaauguucuaaaggccucccuguguguuuuagcugaaucucuucucaauggcuccaguguuaauagccagaguaguuaauaaauauuaacuguuauguuuuuaucuaggcugaaacucuuuucugccuguggauuguaagaacugucagcagucaauuuugaaaaguccucugcagaggaaggucugcaauaaugauaauuaguacuauaucauuaucacaacugauauuauuacuaugugccagguaaugacaucgguuuugauaaugauauaguaauaauaucauucuaacuaugcacauagaauauuuuucuuucaauuaagcauccauagcccccaugagagaaguacuaucauuauccucgacuuaucaaugaagaaauaaagcauagccaggauaaagaguuuucccuguguuacguagcuagcaaagacaagagauggaacuucagagucucaguccaaagacauuacacuaugcugcuucaucauacaugaauugaugcaaaucauuaucuaucuguugauacuccucuuugauucuuuuucucucauuuuaugucuucaguuuauaaaguaaugguuacuuuccacucccacaagaucuccaaacauucccgcaagcagaauugccaguaucaaaguguucauuuccuguucugacaggguugaacuuuaaaaggccuuaaggcaagacagggaugguagcugguaaagagagagagagaauauguguguguugugggugacuucaauggccauuuccuucccagaccuucuccuaguucaaagucaagacuaaucaagcauggagcuuccaccaaacaccaagcuaagcaaucauaaaucuucacaaucuuaugagagaaaaagagguacuguucccacuuuacagaugagaaaaccaaggcccagagacaugaaggaagcccaguacuuacaacacaggacuuggggagccugaugccuuaguggucauacccgaaaaggcaggcaggcaggccgggcgcgguggcucacgccuguaaucccagcacuuugggaggccaaggcagucagaucaccuaagguugggaguucaagaccagccugaccaacauggagaaaccccauuucaacuaaaaauacaaaauuagccggacauggcagugcaugccuguaauccuagcuacucaggaagcugaggcaggagaauugcucgaacccgugaggcagagguugcagugagccaagaucaugccauugcacuccagccugggcaacaagagugaaacuccaucucaaaaaaaaaaaaaaaagcaagcaacauaggcaggaaggacuggccuuucagccucccaugugagaccccucaaacuggccuuagucaccuugggguccugcucucuggcaagaaccuuggcucuucuuuuuaaaaagaaguuugaucuggcauuuugcuucaaguuuguuaugagcaaauaauucucuucacaaaucaugucugaagaggagagaagccagaacaaaauaacaaaaaaaaaccuuuuuaaccuuucuugaugaaaugaguaauagccuaagaaaacaucacugauuucaguuugucugucucacaaaacacauaaauacaacccagucuaauccuuaacuucacaugauccucucaagugaccgaaaagcuccaaggggguguauguaauucaacaaaccccuacuagcuaacaaggcccuccaaagcagcugagccuaguuucuuucugcccgccauggacgaaggucauucaacuucagcccuuuuaugaauggaaaucagcuuuguaaagacuguuuggcaggcagugaccagcaacagacaacucaaugacugagcuuucugagucauaaaauacuuuugaaagggggagaucaaagcgucccuaccgccuauugaaauccaauuguuuccaaaguucugcaagaacccaggcucucuggagaaugggucacugcagucauagucuaaaaaaggccaccaguaaaacaaagauacaauggggacauuagugcagccagccaugggggagaaacgccacuuacgguuuaauuguuggggacaaagaaaagagaaacgaggggaaaccgagugacaaaauuggaugaugcaucaggaauugaggcuggagggaguucucauggcagccuugaucacgguacauacuccacucagagcaucagaugcagugcuaaggcuggaugguaaucagacaccgggcagaagauccaagagaaacagcaaagcaguccacuacucuugccagcugggccuucacugaaguuauucaucagugguaaacucacccauguauuacaaagcugggcagaaaugcaauaugacugacacuuuuugcaugucuuuucaaucaaucuucacaugaagaauggagcuugguuuagaauuucuuaagcaaggggugcauuuccccaacgggaacacauguccagguacaaguaaaguacaaauaaucucagacuuaggaauugcucuuuuagcgugaaccgcagaacccugguacaagauguugauggaagugugguucaaaaagaggaggagugggccgggcacgguggcucacaccuguaauucuggcacuuugggaggcugagguaggcagaucaccugaggugaggaguucaacaccagccuggccaaaaugaugaaaccccaucucuacuaaaaauaacaaaaaaauuagccaggcguggugguggaugccuguaaucccagcugcuugggaggcugaggcaggagaauugcuugaaucugggagacagagguugcagugggccgagaucgcugcacuccagccugggcaacacagcgagacuccacaucaaacaaacaaacaaacagaaacggggaguugguggggaggaguggucaaauuaguauggaaauccuaccucuuggcacuucacaaugcauauuaguguauuaaaagguaugaaauauguuaaagauguuuguuuagcuuccuuuaaaccucuaaauuuucccuaacuuguaugaccauaaaccacuuauuccuggagcaucucuuaacaguuaaaaauuaauacauaauauuauaguaucuauuuuggguaccauuguguugauguuuuucaugucaccaccaaacugugaagagaugcuccuuggaaaaaaaaaauuucauuggccaaagaaguuagggaaacuauagguauaaacagaguuaaacaggugucuuuaauauaagacauuucugacuugucaauaugcuaauaugcauuguacagcucagagagguugcauuuuggcaauaacuucaccagcuccccacuuuucuaaaaccauacuguguaaacuccuuguuucaggguugaaucacagcuugguucacaauaaaaauagcaguugccaggucuaaaaguauugcuccauucucuucccuagauuguaagcucuacgaccuggaucuaacaugcaucuuguugguaagcuucaucuaccaugcucucaacagugccugacacacuagaggcuaauaguuguccaaugaaaaaaggauaggguggggugugguggcucaagccugguaaucccagcacuuugggaggcugaggcaggaagauugcuugagcccagaaauuugaggccagccugggcaacauggcaaaaccucgccucuacaaaaauuggccugguguggugguacgugccuguagucccagcuacuuggggggcugaguugggaguauugcuuaagccugggaaguugaggcuccagugagccaugauuauaccacuguacucaagcccagaugacagaguaagacccugucucuaaaaauauaagaacaauaaaaaaugaugagucaaugugucuaacaaguuccaaaaauacaagcauuuucacuaagugguucucagauauucguaugcaucagaaucaucuggagaauuaaaaauacaccuuccuguguccagccucccugagcuucuguuguagacaaaggaauucacauuuucagcccuucaagugaagcuaaucauaguuguucacacucugauaaucacuguccugacaaaaaggaucacuaagacagaugauuuuugagcaguaaaauuuuuagaucucuuaguacauaggaagaaacaugcaaguuuguucuguuggaagacaaaauuaagaaauacagguaaaaauuuuaagacugugguucaacagcaagaugaagagucuccaccaaugucauggcuugcuggauguaaugacuuucucaucacugugcuagucagagggaggcuggauauaguagaaaggacagacauggcagaucaccauuagauuagguuaaucuguaccucugagauucugggacaaaggcugcaaauccuagcaccuucacagauuauaaggccaccugguauaaaaaacaggggugagcuuuucuagguuacccuauaaaagcauucaaaauuuuaaaacaaucaucucuaaacauaacaguaggcaguuuuuacucagggaagugugcaaccccuguuucaugaaugaauuauuccaaguaaguaacaacuaccucaauucuggaauaaagggagaccugugaguuggcaggggaggugggugcauuuuaagaaauuauuacaaauauuucaaacagguuaauucugaauuauuaaggcuaacagucugcuagcaaaauuuuagcuggaguauguaugcacgcaugucugcuuauauguauguacguacauacguauucacuauuauaaccauucuaccauuuuccacuuucuuuggggacuucucuagcagacaagauaaugguagauuccuauuaguacuuugucaaaucauuuaaaggugacaucgcuuuccuaauauacacugcaugcacacuagaaaauugcuaccacauccaaaaggacccuaaggccaguggucuggccccacucagagaaacacugauauauaaacuucaggugaaaaaguuucaucucccagucucauucaucucuucucggucucuguauuaauaggagaaggguggcugucucuccuggcauguuaacucgaugagucucuccaacaagccuguuaaaggcuuguuccuuuucugaacucuugaaucaucuaugauucugaaucuauuacuauagaugcuaauuaauuucagaggaguuaugaaccccugauuaaccaaagaagcugagcaaugucuaagaaaauguaaacaaaaaagugcuuucaauuucauuaaccaucagaacaaugcaaacuacacccauaaugugguacuacuucacaacuaucaaucagaacagcuaaaauggaaaaauaggcaauaucaagucuucaggaggauuuggagcaacuggaacucucauacacuggugaugagaguuuaaauuaguacaaccacuuugaaaagcugcuugucaguacucauuaaagcugaacauauacaaguugaguaccccuaauccaaaaauuugaaaucugaaaugcuccaaaaucugaaacuuuugaguacugauaugacacucaaagaaaauccuuauuggagcauuucagauuuuuugcauuagagaugcucaaccagaauauauucugcaaauauuccaaaauccuccccaaauugaaaauccacaacacuucuggucccaaacauuucagauaaggaauaacucaauuuauacauacucugugacucaacaacuuuauucuuaggcauguauccaacagaauguguccauacguucaucaaaaugcauauacaagaauguucagucauaacagccccaaacugcugguggggguguaaauuaguucaaccauuguggaaagcaguauggcaauuuuucaaagagcuaaaagcagaaauaccauucaaccuagcagucccaguacuagguaugagaagaacauaaaccauucuaccauaaagacacaugcaugugaauguuuauugcugcacuauucaccauagcaaggacauggaaucaaccuaaaugcccaucaaugacagaguggaugaagaaaaugugguacauauacaccauggaauacuaugcaaccauaaaaauaaacgagaucaggucuuuugcaggaacguggauggagagcaaggcuauuaucauuagcaaacuaacgcaggaggagaaauucaaaucccacguucucacuuauaagugggagcuaaaugaugagaacucaugaacacaaagaagggaacaauagacacugaggucuacuuggggguggagggucggagaagauagaggaacagaaaagauaaccauuggguacugggcuuaauaucugggugaugaaauaaucuguacaacaaacccuugugacaugaguucacccacgugacaaaccuucacuuguaccccugaaccuaaaaguuuuaaaaaaaaauggauaaaaacaucaugaaaucuucauacagaaaaauuuuaugauucuacucaugugaaauuuugauaauauuaaucuauuacuaugagauuauuaauuugagacaauugauaagauuucccaucacucacagagugaaguccugagagugcuaaacaugaggaggcuaaauuuugcugaaaauagaacagcuauagagaaauuauucccugccaggaacugcuauggcacuuuccacauaagaaauaauugaauccccacugcccugugauguaaacucuuguuauucccaucuuagaaauaaagaaacuaaggcauaguuaacucuacuuaacacagaguuaaacaauuugucuaagguccuaugaguaaaugcuggucugagaauuagaaccugggcagacugcuuucaacuacugguauguggaaugggauaguuuaagccacuacgguggguuguguaaacuccuccuuuaggacaccggaauagacagaagaaagagaaauacaaaggggaugcuaaguaaagagaaggagaugugccacaacaaaacaaacaaacaaacaaacaaacaaaaaaacaagauauagucaugugugcacacacaggggcauguaaccauguuauaauauauaggucaauggugagccauguucaucauuuuaaauagaccaaagaaagaauaccgugauugugguuguaaugaaagguuuuagcuaaauuucaggccauaauagggggaaaaaauuaaaaaguaacugaaaguuucaacuaacaaagaacaugggaguccgcauucacccguacccaagccaccccucuugcuuugugccaugauguaccauguacauuacucacuacauccucacuugggcuuucucacauuuuccuucuucuggccaugccagagcacaaucaccaugugucucaacacacacaaacucuucugucaauucaagacacuucucaaucacaacacagaaugaaaucaacccagaacaacauuuaccgccucguauauuugauugaauccugagaagaguaucauuuacacugauauucuuggccuggugcucagcagaugaggauuacauagggaggaaauaacacuggucccaaaugcuuuuaaaagguucugcuucccugaaugccacauuuaauccugccagcccaggaacacagcaccccacauucuaaaaggaugucuuaugugagcaggacaccagcaacagauuaguucaaagaagacaaaaggccucccuucagcaaagugaagguugaucuuaccagugcugcugaaugcaauuucgcauugaaauacaguuuucccauuucaaagccauguagacgcaugaagcuuguuagauuuauagaaugccuggucucccgggacauuacaaagcgaauggcauccaucaaguuaauuuccuuggggaucaucucaaacauggagaaugaaaagucccagaccauuaaacaucaaaagauuguucuaaaugguaauuaaaguucuauuauauuuucuuuuucugggagcacauuagauuaauucaauugagaauauuagaaguaucaaggcugacagugugaauguguggaguuggcuggaagagcauuuauauugcagacaucuguucauucaaguuacacaaaacacgaaagagggagcucaacucagacugggguguacuuaccaagccagcacacguagacacagcgacagaggaggagcugucauuucugauaaaucccugauagaagcauugcugcaccucggguuucugagucucugaagcaccaucuuuuccaaguaccuggacaauaaagugacugcucaaaaucgccgagggcuuaaguucuaagugcaguuccuguccaaaugcugaaaaucgguagugcagggagcuucuggcauucugcgccgaucgcuuuuuccugccguugugcaaaaugucgugugaaauauaugacccggcugagucuacuucuacuggcgugacaaagacguaaucugcaaugggaaaaguucagcugucagcacccagagcccacaauuccaaauggucucuuuccagcaagcuggcaaagagcaacacaaagcucaaagauaucuuuguuccuauugccuugcaccuagaucaaauauaauucagagcagcacaggcagcagaagaccugucucuacaacuaacucggccacagucauuucuacaggugcccgaaagccaagcacaauuuugaugaauuucauggaugucuguggaaaaauguaacaccucucauugucuggagagagauuuagaacauucuuuugauguuuaauggucugggccuuuuauaauauuggccacagaaccauucauauauauaaaauuuaauuuuuuugaagauaaaguuaauaaacauaaaacuacaaaaucgggaaauuucuucaaggagguuaauuucucugugcuuaaacugaaucgggaacauuuuggcagaggcagaguuuacauuucaaguccuaacucacagugugggguagccucagaugauauuucagaucauuaacaagcaacagcauuuucauuuuuccaauauuauuuaugugugauaagaaaacuccagcacuuguaucacccuuagcauuuuacugugagcuuucacagggaugaucccauuuaauuguaagcauaaaauacagugcaugcacaaaaaugccucaaaauugucagaacccuccuauauagucugauguauaaaauugcucaggcauguuggugggggagugucagaucaggggacaccuggaaaggcauguuuaaaaauaccuucaccacugcucccuagagcaguacuaauugcugaauguuccaaagaggaggagcuaaaauacaauuugcuauuugaaaagcaaagccagcacacuguuuucuuucaccaaacauugaagcugaaaagcaucaucccacaaaaugauuuggaauaugcccucugugcauuaaaaaacagccugcauuuccacuuucaaggcacagaaugggaaacuacuuuggaaaguguuuagaaagcuguugaauaaugacgagguauguuugagucacuuggguccccaguuacuggaggaggaaaaggaagagaaauuucucuuuucccuaaacagucaacaaccuucccccuccuccaauaaaaaaaaaaaaacuaaggaauaguggagccccuguagcuagcaaagaucaaugagugauggccuaauuaggcucacauuaaaaaagaauucuccacaauagacaauaauuuucuucuguuuaugaaccaucugugacuuauuccuugggcagcuuucauuuuuauauucuuuauguccucccacucccauuuuucuucuugacucccuccuuuaacuaaaaaugcuguauaauugacauacauauuuuacaauaauggggggaaaaguuuuuccccucucuuaaccuugaaaaucugagccagacauacaauauuuuucuucucuuaaaaaucugauacauugcuuuaaagggauguggcucuugauuaugugcaauuucuuagagaaagucuaccuucuccuucugucaaacuaaaacuuaacuaugaaaaagauuccugacauaugcaggaagucugugucucaccuucuugucccaaaucaucugaaacucugccugcucuuacuuggaaggcucuguaggaacguuauccagccagccuucuauggaaccagccaucaaacggccccagacaccugcuaccagcuuguuuccaaggggagaauaacaggcugucgguuacauucgguucuugauggaagaagggcagucaguguccccuguaaagagugaucucugauugaccacuucaggaggugaguaagggugagguccuuacaagguuguggcugggucggacguggccuccagccaucugauccugauauaagaaugaggggugguuuuagaaacugcagccucucuguuuggacaaaaggugaaucccuucuccaugacuccauccugccccacuccccauuccccugacaagaaaaggagauaaccuugcaaaacuaaaaauuacagaauucuaaagaauccagguugagcuguaagguuuuccuagacaccuugcgucaggaaucagcuguucuccuguagcugaugggaaacaaucaaaacaaggauuucccucugggcuccacugggaaguuaauaaaugucagaagugagggauuuucuggaaguuuguggcuggcgaacgucagaaaagauagauaaaggacucagagaccugaagucaccugcuuuccucucucuaaaagcagccuuagacauccguaaaacaagggaagcagaaaugaaaaaaaaagaagagauagaaaaggaacagaagucgagagaaaaaugaggaaagauggagagaggaaagaggcucacauucuuucaucucccacuaagaauuagcuucccccaacaagaguuaggagagggaggaaauaaguaauuccuuaguuaauguccacuucccuucgaauuucucacugcaguuaggauuuuuuuuuuuuucuuguucuucuuaacaagccaccugugaaggagggagaguauuugcuuuuaugugacuugcagcucggggcguugauucuuuugauaaguucaguccuugccaaccuuccccccucuccaaacaggaaccauuuccaagacagcgcacaccugccagguuagggggugcgcuuuuccaucuuuucucucuuugggggaaggaagggucaaagugcugcgaaaggcccuucuuggggauggggggcaaauacgaaccaucauuuaauccgcuggcgccgcugcugcugucacuggcuaaggccgcggcgaccgacgcacagcagaggcagcacagcuggagcgccugcaagagaaaaggugacaucgcgcgugaggggcgcggcggggcuggcgucgggcgcccccugccacccgcucucggagcuccgcucggcggcaccugccuuggccacgcgccccagucccgccaggccccucggcgggcccgaacccgcagccgggaaggcacacgcgagcaggagggcgcacuccauggucaggugcggacgcggcggcugcggguggccagacgcggcaggcggagcgcacgggcggcgcgcauucuuuccgcggccccggagcucggcgccccaggugcggcuccaggugagagccgccgccguucacaucgcagcgggggcgcgcugggaccuccccuccuccggccgccugcgcgcccucccuucucccggcgcgggccugccgagcugcaguuugcggcaccccagaggguacggggggcucccugggccgggacuggagcgcaaacgguugggagacugucggugucugcccgcccgucugugcgucugucugugucggugugagcgucugaggcgauggggaagacagcgccagcuggcucccccagcgcgccggagccgagcgcccgccucuccaccgcgcggugauuggcgaccagcggcu

SEQ ID NO: 21450 - RNA, 1112981 nt, Homo sapiens
ccgacgcgcgcgggucucguuuggagcgggagugaguuccugagcgaguggacccggcagcgggcgauaggggggccaggugccuccacagucagccauggcagcgcugcgcuacgcggggcuggacgacacggacagugaggacgagcugccuccgggcugggaggagagaaccaccaaggacggcuggguuuacuacgccaaguaagggggccgcaguggggccgcggacgcaccugggacccugcacagcccacggacgccaccugcgcggggaggacgcgcacuccagcgcagcgcgugcggugcaaagugaaaguaacuguuaaggagcuucagggaaaaggguccaggguucccaguaggggccggcccccuuggugggccucggguccagcgggggucaccugguggcuucccggcgcgcccucugcuguucaggaugcagcacugcgcggcgcggcgagggcaaagcggccucauccccgccaaaaaauaaagauguuuuaaaaagcgcacaugcucagcucccuccugcaggcucuggguugcagggauaggaguuuuguuguguuuuguuuuguuuuguccagaccgguauugcucagucauccaggcuggagugcaggggugccaucauagcccacuguagccucuaccuacuggguucagacaauccucucaucucagccucuugaguggcugggacuacaagcgugcacuacuaugcccgacuaauuuuuuaaguauuuguagagacuagggucgcaccauguugcccaggcuggucucgaacuacugggcucaagcaggccaccugccucagccuccagaauugagauuacaggcgugagccacugcgccuagccaggaguauuuuuuaguagcaguccuagauagcuucacuaucauuuccugggaaaguuuuggaaaccccagcagagccuucaucuuuaacugugugaccuugggccauugaaauaacguuuaaucuugguuuuuucaccuguaaaauggguugauacgagggucaguucaggcacugugcguaaagcacauagcaccgugucuaguagguacucucuguuccuuaacugucguuccuugauugcucuuaagauacgacagugccucuuauaucggcaccuuagaaucaccuaggaaauguccuaaauacacguuuugggucuccauagagaaccuacuguagccgacucucaacuuugggagucucuuuuuuuaagcuuuccaggugagguggaauaucaccugguuuugagaaacauggauguaaaucugauuuucagcaucugggaaacuuuuuuuguaagagccuuuuucugggccccacuuccagaggguuuuucuuuuuuuuuuuucuuuugagacggagucuugcucugucgcccaggcuggagugcagcggcgcgaucucggcucacugcagccuccgccucccggguucacgccauucuccugccucagccucccgaguagcugggacuacaggcgcccgccaccacgcccggcuaaguuuuuguguuuuuaguagagacgggguuucaccguguuagccaggauggucucgaucuccugaccucgugauccucccgccucggccucucaaagugcugggauuacaggcgugagcuaccgcucccggccuuuuuuuuuuuuuuuuuaaagacagggucucgcuccgucgcccaaacuggagugccguggugcgaucucgguucacugcaaccucugcaugccgaguucaagcgauucucgugucucagccucccgaauagcugggauuacaggcgcccgccaccaggccuggcuaauuucgcgcuguuggcccggcuggucuccaacuccuggccucaagugauccgcccaccucggccccccaaaguguuggcauuacagacaggagccacugcgucagcccagaauuucugauuuaauugguuuggccccuccccucucccuugguagguuguaaaaucuucccucccaggugauucuaaucuaugcaaggaugugaaccacugcugccuuugguggcaagguagaggaaaaacaaccaaguucugaugaguucauucaagacacacacagguauuaugugacaggccuuuggcuggcacugguuauaccgaggcaaauaagagccaguugucauccuuaggacccaaucuuauuagggcacagugacauguguaggagcguccccacgcaguguguauaccaggaaguagugugucuggcaugagguguguguagguaguugggggggucgugagggaauaugguggcacccucacaguaaccuucacuuccugggcucaagcgauccucccgcaucagccuguugaguacccgggaccacaggugugugccuccacacccagcuaauuauuacauguuuuguagaaauggggucucaccauguugcccaggcugguuugaacuccugaacucaagccagccucccucccgaagcacuggaaucacaggccugaggcacugugccaagcccagagcgguguuuugagcucaaguagagguggguggggcaggagggcagucuagguagagggaacagugagaggagagacccccugcauggccuguccaggggccugugaucuuugugaggguccaggaaugugaagguuaaggcagggaagggaggacccauuucaaggauuucugugccuugccgagaagcuugggcucuguuggcagagccagagaguggcauucauucagcuugugaauucuggaagaauuucuggcucuggagaauuaaagggacauuuccagcagcagagcuccaguagccuuugcagggacggaggcaagcuccugagcgggcacuugcuguuccucucaccuguacaucuguuggggaaaggcuccuucucauccuucagagcugagcuuacaugucacugcccaagagaccuucuuaacuguggguguccccucgaccuuguacuagucaccuuguuucucugcuucuucgugcuuagccuuggcuguguacuccuccuuguuggcccugucucccuugcccagguugcagaugucauggggcagcuuguucaucugaguguccccagugcuuggcacccagaagccauaagaugagccccugugggaugaguaaaugaaucaccuugggagggucagccgcaggcuucuguggguggguggguggugcacugggccccagaguacaaagaugcacaugacccgcuuccggcuuccuaagcccaccucugccucuggcucuguggggcgucuccuccuuugccacucagccccagaggugcuucugcuucccugcaggcuugcccuggagccuggcgcuagggcccuggggcucccuugcuccugcgugcccccugcgccugccuuccugcugccuggccuuucucccaucugcuuucuuccugaguggccccuggccaggggacucgggugcauacaugguuuccaaacgccuuuccuccagcccucccgacuagugucuuaaaucucaagcuggccucucuggcuccgcuguuuuuuuuuuuuuuuuuuuuuuaauuuaauuuaacuuuaaauuccgggauacaugugcaggaugugcagguuuguuacauaaguaaaccugugccauggugacuugcugcacuugucaacccaucaccuaguuguucagccccccgugcauuagcuauuuauuguauacaccagcugagaugccagggcuuggcuggcucucagcuggagggcucacucucuggaccuuguguccgucccugcuggcccucaguucucuggaucaggguugaaaggcugaaauucuuuggguguuagcuuaggaugccucugauccauccuaacccgacauucccuugaucucuccugaucugugagcauccuggcccuucuuuucuuuucaguuuuaauuuuugcgcuggcuccaaccccuuuucauuccugacucuggaagugacacuuguuuuucucuugggguuugggaaacuuugugguuguucuuucuaggaggcugcucuuugagucauuucuuuuccauauuguuucuccuacuguagcagggccauggccagggauagaggcuguagcucccacugagaccucggggucugguggaacccggucuugugugggugcugucggccucuccugcuuucccaccugccucacgguucacuugugugccucaaaggcacacauguccuagcacuccaaagcccaccagggugggcucccaggggugaggucgagguagaccgggaacccaagagagcuggugggccuuucuucuaccccucuccccucacagucucagagcagccccuucaugggagaugggaagugagggacaaggucucagugucagagccguccuuguuugcccuuccccgugccucuuaugaagcucaggccuuuuggcagucagaggccucaauggugccuguguccacagggcuggcuguccucaccgugaagucuagaucucccugcuaacuuacacugugcucaaaacacacacacacacacacacacacacacacacacacacacuggcuguccucacugucaacucuagaucucccugcuaacuuacacugugcucaaaaaacacacgcacgcacgcacgcaugcacgcacauacacacacacacacacacccauaggcuggccauggugggaggccaaggugggaggaucgccugagcccaggagcucgaggcugcagugggcuaugauugcaucacuguacucuagccugggccacagaaugagaccuugucuaaaaaaaaauuaacagaaaacaccccauacguggaagugugguauucacauaauaugauguucacuuaaauuugaauccuuugguuuaaguuuagauuacucuuaauuaucuuuuuaaaugacaagcucguugaaagaauaaaaaaucaaagacggcuucuauuuaaaggagaauaggagaaugcuuaggggacauguguucuaauuuucucuucauuaaaaagucauuuaagguuauaauuaaaaagaacaucuuuuaauuaauuuuuauauuuauuaaaaaaaagucuucuauugaaagguacaguucuuaguucuucccguguuaacucacucgguucucuauaaccccaagaaguaagugcuguuauuguccccaucuaaacuguugaggaaacugaggcaugggauuaaaugacuucuucaagggcagaguggcuggcaaaugggagacccagaaaaccuuggcaguugggcuucagaaucuucacgaccaaauuacucucucugcuucagcugguuccggauucuuccccagggaugguuguguccugcaggggacggcuggcaaugucuggagaugcuuucuguugccacagcuaugggacugggguauuggcaucugaugggcagaggccaguggugcccaaggcagccccgcaacaaagaaugaugcaggccgggugcagugguucacgccuguaaucccagcacuuugggaggccgaggcagguggaucaguugaggucaggaguucgagaccugccuggccaacauggugaaaccccaucucuacuaaaaauacaaaaauuaucccggcaugguggcaggugccuguaauccuagcuacucaggcugaggcgggagaauugcuugaaccugggaggcagagguugcagugagcugagauugcaccacuguacugcagccugggugacagagugagacucugucucaaaaaaaaaaaaaagaaugauccagccccaagugccaccagcagugagaauaagaaacccugauucaggcauguucugugaaagucaagaacguagguugacagaguuuguuuuguuuuuuaaaugucuuucugaauaaauaaaaacuguucugagugaguuuuguaguuccuuuggaaaguauucauucuguuuguuuacauuugugcgccugcugugggccaggcaugaggcuacaugucugagggcccagcuucaccuucuaagggcugggaggcucuuucuaugccagccugccugccaacaaggcucagcuuccacuguuaagggucauuuuguggauuuuuuuauuuuuuauuuuuagguugagucuugcuuuuucgcccaggcuggacugcaguggcgugauuuuggcucacugcaaccuccaccucccagguucaggaaauucucaugccucagccacucaaguagcugggauuacaggcaugugccaccaugucugucuaauuuuuguauuuuuaguagagaugggguuuugccauguugccuaggcuggucucgaucuccugggcucuagcgauccucccgccucggccucccaaagugcugggauuacaggcgugagccaccguaccccgccacuccauggauucuugagggcagaguuuuuuggagccaggcuucaagcacauuugaugugugccuaugagauaaagacugcuuuuaauggcaggcaaggaaaaugcaaguccaucucuuaacuuucuugaagaagcuugagacacagcucugcaaggggcuggaagguuucauguuauugccaaugcuugguuuaucugauugcuguugccauucauuuugaaggagaagcaggaguugguauaccaauauucccacugugccagcagagagcggguuauccuuacuagagagccagagagucagaacgguuuuuuuuuguuuuuuuuuuuuuuuuuugagauggaguuucacaauuguugcccaggcuggagugcacgaucucagcucaccgcagccucugccugccggguugaagcaauucuccugccucagcuucccgaguagcugggauuacaggcaugugccaccacgccaggcuaauuuuguauuuuuaguagagacaggguuucuccauguuguucaggcuggucgcgaacuccugaccucagguaauccgccugccuugcccuccugaaguacugggauuacagacaugagccaccgcgcccggccacagagcugcuuuuuuuugcaagugauauuggauggugguugauguacaaaguaggaguuuguccuugcuacugauaccguagcugguacaagguuuuaaucguucuccaagcacugucacaggugucaugugucucgccuuuucagcagcucugugagguggcaguagcccugaggagacuggcuggacucagcuagcaugggcugcucaggucuucagcgugcugagugaggcauuccugcacuaugacagagacccagcugccaagacuuugucaaacagaccagaagccagcaguucaugaaaagaccuugcuugcaaguuguagaauuuuuuagaaaauucgugcucucuguauuuauuuucuguaaaauaauugauagggaaagaauguucacaucuuaucaucuagauguugcugauuaaauaauauaacuuucuggguuggcaugaguaggugaacuuuuaggaaacgcagccuacccuucgaauaccucuuguagcaccuggcuguuucccuuuugaaauaauuguauguuuuccuggauaccuuauuaccuggugacacguguuucuaguuauugaccuauguuuuuaauuauaacuuugggugguggucugaaaugaaauguuaaguuugacgcaaaaauaggacuaguuuguguaacugauuuguucagaauaacagcuuacauuucucagagcuuuuuguaugccaagugcuaugcgaaacccuggauguacaauauucuuauaguagccccugagaccagugcuaggauuauuuccauuuugcagaugaggggauggagauuaaggaguggggucacuugaccaaaggugcacagcgcacagcuagaugcccuaugggaaggucuuacugcaucucuuaacuaccucuugggaccaguuaggaaccagugcuuaaugaaacacuuugaaguuacaucuguggaaagaauaaacauuuuagcugggcaagguggcacgggcuucuagucccagccacucaagaggcugaaauaggaggguuacuugaguccaggaguuccaguccagccugggcaacauagugagacccugauucuuuaaaaagaaacacaaauaaauaaacauuuuaagagauuauauaaauuagauauuaugaauuuugucccuacaucguggaauaaaaccaaaacaaauacacagcaaaaugccucuagauuuauuuauuuauuuauuuauuuuugagacagagucuugcucugucgccaggcuggagugcagcggcgugaucucggcucacugcaacuucugcuucccuggcucaagcgauucuccugccucagccucccgaguagcugggacuacaggcacgugccacuguccccagcuaauuuuguauuuuugguagagacaggguuucaccauguuggccaggauggucuccaucuccugaccuugugaucugcuccccuagggcucccaaagugcugggauuacaggugugagccaccgcucccgacggccucuagauauuuugagugauucagcaaaccuccuaaaguugaccccguagcuggggucacaguccucuuucuccuucuucccccuacuuccuucuuauaucuggcuaucugggagagaaaaaauuuaauacaauugauuacuuuuuagaagaguuaauuuuuacuuauuacuguggauuuuuuguuuuuuaacagucacaccgaggagaagacucagugggaacauccaaaaacuggaaaaagaaaacgaguggcaggagguuuguauguuguugucuaaggaucuuggauggaagcauuaaguagaugaggaaaugucacuggcagagaggugacagguuauuguguguuuagggagggcucucugguagagaaccagacucccacucugaggagcuuaugggauuuggcagaagaagaugaugagaucauaggguggagugaggaugauuucuuacuggucuuaaaguaccaaaauggccagaugugguggcucaugccuguaaucccagcacuucgggaggccgaggcggauggaucaccugaggucaggaguuugagacuagccuggccaacauguugaaagcgcaucucuucuaaaaauacaaaaauuagcugggcaugguugcaugcgccuguaauuccagcuacuuuggaggcugaggcacgagaagugcucaaacccaggagcuggagguugcagugagccaagaucacaccacugcgcuccagccucggugacagagugagaugcugucugaaaaauagcgacaacaacaacaacaaaaaccagaaaauaauugaggccuuugauucacaguuuaugauguuuuccuaucguugcaguguuuauaaaauuguucuuggcuauacuauggaauuaaauauauaaguauuuggaaauuucguaaagauuaccaugacuucuaggugauucugagauaauguaugauccacggaauagaaguauaagaaagggacaggcacgguggcuugugcuugugaucccagcccuuugggaggcagaggugggaggaucacuugugccugggaauucgaggugagccuaggcaacauagugagaccccaucucaaaaaaaaauaugagaagguuccugcccuuaagagguuuaggauccagcugaagaaucaacaugugcacaugaaaaaaaauggccgugcccucuaaugucauaugaggucagcguaugaaugacguugggugccugcccugcauauacauauguucuuugagcucauucaagggagaauucccauggauuggcacaaccaguaugguuuauagagcgaucaggaauaaaauagguuuucuucaaaacaagaggcaaaaauguggagcccagggugggaucaggggccuucugcagcugucgcaguuggaacaugugacgaaagccaguugaugugacaacugcugggugggagggacaggcuugggggcggggcugggagggcuccuucccuuccugacccagggauggucuuuacuucucccuggcaccuguagaccugucuuucuuguguuucagauuugccauacggaugggaacaagaaacugaugagaacggacaaguguuuuuuguugaguaagugucugcaaagaaaccacucucagcuguuuugcuuuuuaauaggaauuuuuaauuauaaaaguaauacauaguaacuguagaaaaauacaaaguauaacaguguguaucuguaaucuuagcagaagugacuacuuuuaacaucgcuggaacuuuuaacaucgcuagauuuauucuucuauuuuccccgcacacgcauccuuaaaaaaaaaaaguagggaggccaggcaugguggcucaugccuguaaucccagcacuuugggaggucgaaguggguggauccugaggucaagagaucgagaccauucuggccaacauggugaaacuccgucucuacuaaaaauauaaaaaugagcugggugugguggcacgugccuguggucccugcuacucgggaggguaaggcgggagaaucacuugaacccaggaggcggaaguugcagugagcugagaucgcgccacugcacuccagccugggugacagaaugagacuccuucucaaaaaaaaaaaaaaaaaaaaaagagggaaugcacuguguggacuguuuaguaaccugcuuuuuccauguaauauauuaugagcauuuucuuguauccauaucuauuuuucaaaaagaugcuauuuagcagcucuagaguuauuauuuuguacagauauacuauaauuuaucaaauugccuauuggacauuaaugcuaaauuccuguuauagagaaccuauaauuauaaauaauguauugagcauccuuaucuguaagacuuuuucaccucucugauucugucuuuaggauaaauuccgguaucacgcagcaauaguaaccaccuguccaacauauagcaugagccaggccugauucuaaucaucuuguaucuguagcauuaggucauuggauccccacagugcccugagagguaguauuguuauuaucccuagcuuacugccagugacacagacuugaggggguaagugacuuguuaaggaucccacagcaaagaaguagcacagccaggcuuugagcccagcaccugcuccagggacuguacucuugaccaccguaguuaagaggagaauuaauguuucacaacugucaacauuuaaauuagaagcuugaauagucuuugacaggauuaggauugguugguuaauagaaguugauuugagcaggaauuuuuuuuuuuuuuaaaguuaugaauguaacauaaacguuucaguauuugauucaaguacaccaacauuuaggggucgggccagcccuccucugagugugaguccacuugcauggauccaguguggucuuccuuccccuaagcaugccuguaacauaacaucuacaauuucuacuuucauuuuaugugggcgaaagaguaccuaggugccgaggcaagagacugaaggcacaaacuguuucaguauaauaaagaaaguaguuagaauaagaauagucauaauacagguuagauauggagaugaucauggacaauuaucaaucauuacuauaaacacuauuaaucauuagcuuuuaauauuacucuuuguggcauuacuaacauaaccuaggaauaacuggcauguauaggcucaggugcuaaagggacauugugagaagugaccuagaaggcaagaggugagccuucugucacacccgcauaagggcugcuugagggcuccuuggucaagcgguaacgccagugucugggaagacacccguuacuuagcagaccgcgaaagggagucuccuuuccuuggaggagucagggaacacucugcuccaccagcuucuuguggaaggcuggguauuauccaggccugcccacagucauccggaggccuaaaccccucccuguggugcuguguuucaauggucacguacguuguccgcuuucaugcuccucccguacuccugguuccucuuugaaguacguaguagauagugguagaagaaauggugaaaguuuuaaagucuuugaucuuucuuuuaagggcagaaaagaaaaugcugacguaugcugccuucucucucugcuucggcuaccuaaaagggaagggcccucuauccuguaaucacgugacuugcuucaccuugucaaucacuuagaagauucacccuccuuacccugcccccuugucuuguaugcgauaaauaucagcgugcccagccguucggggccacuaccggucuccacaucuuggugguaguggcccccacccugggcccagcuguuuucuccuuaucucuuugucuugugucuuuauuuauuacaaucccucgucucugcacacggggagaacacccgcuaagcccaguagggcuggacccuacaacuuuaagguugagcaaacacaguauuuucaaagaaucugauugcuacaucauuugggaguuuuaugguauuuuucuagcauuuucacuguaguugauugaaccaaaacuuuuuuuuuagcugcuugucuuugaggcucuccaaagcauucgaccacauuuucauagauaccacugacacuauuuuucaccucccauguuaucaguuuguguaauaguagcuugcugguaauguaguuacaguaacaaguucaaaugacauguguguuuuuugagcaaaccuggugaacuuuuggugcaaaacugauauugagagcaaauaggccaaagcuugcuugagagaagucucccaggccaccauaggcagccccaggaagacggggcugucuagcaguuggauaggugggagugccuauuauuuguuaaaaggcuuuuugccuaacuugugaaaguuuuuuuuccucaacuaauuaaggguaucaacgcauugguuguauguugaaaauguugaaaauguuuuuuuuuuuuuuccaaguuuucuuucuuuuuuuuuuuuuauacugggucuugcucuucuuauccagggcugaggugcagugacacagucacagcucgcugcagccucaaccuccuggacucaagugauccuccugccucagccuucugaggagcugggacuacaggcucaugcugccaugcccagcuaauuuuuaaagacuuuuuuuuuguagagacugaggcucaguauguugcccaggcuggucuugaacuucuggccuucagcgauccuccugccuugacuucccaaagcauucauauuacaggcaugagcgaccacaccugacugaauuucuuaaauuuuuuauguagucaaaucaauuuucuccugugcagucuuugccuuugcauucacgcuuggaaaguuacucccugaaauggguauuaaucaaccaagagcagcaguucucaggcaugguuccuggaccagcagcauuaauaucaccugggaauucaauaaaaauguacauucccaggcccccaccccagaccuacugaaucagcacugggguggggcuugcaaucugcgcucuaauagucauccaggggauccugauguucccuagcuugagagccucccgucuagagcaggggcugucuccuuugccuguaaagggcuagauaauauguuuuaggauuugcagggcauaugguuucuguugcaaugauucaacucugccuuuguagugcuaaagcagcuauacacaauauacaagugaugggcguuguuguguuccaauaaaacuuuauuuacagaaacaggcagugggccagauuuggccagcuccuggucuaaucuagaggaguaagcaagggcuuuggggggaaccuggaaauuggcuccccuggcuaguucucacuuuucugagccuguugcaguggggugcugguaaauguuuagcaccaggucuucagggggaaaaaagccacuguuuguuuccacaguauaaauacuuuggccauagcugauuucaugcugccaaggugaagugaggaauugggaagagauagucacguuuggcucuuguaagccaguuugagccagucuagcauagaacugcucuguuguguguguauaauauuggggucacaaauuaagguuguuauaaauagaaugaggaugaggaugguaauaauuagaauaaagguuggauuauuacucuugagucuugguacuuauagggagaugaguauauauuuuaaacuaauuuuacacacacauacuuuuaaaauaugaaauuucaucuauauuuagaggcuucuuaauaguuuuuaagauauucugaggucuuuaucucauaucccaagaauacauuuaagauauaaaaaguaaauucuauuauaaggaguacucuuuucauccauaugugccuuuuuuuuuuuuuuuuuuuuaaugguuacccagggucuuggucugucacccaggcuagagugcaguggcacaaucauggcucacugcagcuuugaucucuuaggcucacgugaucauccuccuaccucagccucccaaguagcugcgacuacaggcgugugcuaucacacuugaaauuuuguuuaguguuuguagagaugaggucuaacuauguugcccaggcuggucuugaacuccugggcucaagugguccucuugccuuggccucccaaauugccgagauuacaggcgugagccacugugcccagccuccaguauauuuuaauaccauuucuacaagauuuagaucaauuccaaaucaaaaugagugcucguaggagguaugagugcagagucuuaaaaugaaaaucguuagaauuuugguaguuggcagguuucuuauuuacaacuaagacuuuaucauuuugaguuuucuacuucucuacgucuuuaggcccuugcacagggcuaagagauuuaauugaaaucuacugaaaagaguggcugacagaucuuauagcuacauuuacaugaauuacauaaaagcccaaaaccuucucaagaagccuuuuuugagaucuaaggauacauggcaauaguuauuguauguuacagcguauguuauaggcaguucugaaggaaaggauucgaugacuaucuuuuuuuggcacaaaugugauccuucuggaggccagaagauagauucagugggccccaguucuuucagguuuaaggaauaagcauuuuggucuaugaaaaaugggguuuuccuaaaguauaagauugucuuauauuuauaaaugccuguguucauugcuguggguucacugcuuucucuuuugggcagccauauaaauaaaagaaccaccuacuuggacccaagacuggcguuuacuguggaugauaauccgaccaagccaaccacccggcaaagauacgacggcagcaccacugccauggaaauucuccagggccgggauuucacuggcaaagugguuguggucacuggagcuaauucaggaauagguaggcucuucacuuaguuauuuaucuuugggacugcuauaaugagauccacuuagaucuagcuauaauggaauuuuguuuagugguucucugauuuaaacaugacuuuuauccuuuucagauaucguuucauuaacaucacuaccucuuuuuaaauccuaauguugucauggaagccuguguaggggcugaccuugaagucucugaaagcugaacacucagcaaaagacuguggcuauuuugguauucagggaugagagacaacaggcuccgucuaagaguuuuugaccuggucugcaugguguaugggcauauuccaauuaccuggguuauucaaaccaaaauugauugguaauagaauacggggaacaacaagguauuaugucuuuggaacaaaggauacuacagguuucgacuggucacugagcauaucauuuucuuuugggcacaggaucuuauuucucuauaaaauuggagaaugaguuccugucuucaccucuuaauugccaauguuuacccacagggacuaucauggguagauggcucaagaggguauccuugcuucaauaugaugggccauuaaggagacaggagcaaggcgggagcaaaccauaacucuucauaggauuuuauucugauuuugcuuugaucuauuuacauaaguaucugaaucagugagaaccaccugcuuugaguuuagauaugcaucuucagauuugucgacauaugaaacguugcauuuggcugucuucugucaaguucucucuguccuuuuggucccccgcagcccucacacggcccccuugaugcccuccucuacucauuuguuucucuuuccuaauuuuguuuuuauuuuuauuuuuuguggguauauaaaggugucuauauuuaugggguucaugagauguuuugauacagggaugcaaugugaaauagucacaucauggagaaugggguauccauccccucaagaauuuauccuuugagugauaaacaauucaguuauacccuuuuagauauuuuacaaugugcaauuaaguuauuauuaacuauaaucaacuuguugugcuaucaaauaguaggucuuauucuuucuuucuaucuuuuuuguacccauuaaccaucugcacuucuuucuuaauuuugaacaauuccuugaagcugcagaaauauuuucuagcaugauuagggaggcacaggagguaaaaauacauuguucaagggucaauuauuguguuguacaaggugugaaaucuaccagguugccauccgaguggagaauuuuuuuacuguacuugccuaugaagguaaagaagcaaauggaaauuuuuuuuuaagaauugaaaggauuuuauuucaaaucaacucucauaccucauccugggcuccaaauauguucaauccacuugucugaacuucugcauuggaguaaauuuuauauaauugucauugaagucaaaacugauggcguaauauuuaaaacaauggcuggauccccaaucuaagaagaauacauuuuguugaucauauuaaguacuguuacagugaaugcauggacccauacaauuguggaauaauuaagaaaaaaggacuuaagggcuuaaaaaugucuuuuuaacaauuuaacaaguuagccagaaacuuuaaagaucuuauucucuuaaucuucuagcuagacucuuuuucuguaaugaguaagauaugugacuacugauuguuuuuuguguuaaguguucgaacugcuccaugugacauuagauagcagacucuugaauagagcuaaugcucuuucaaagauuugcaacagcagaccugcgacauuguaauccaggacugauagaguugguucagaauauuaaaagggugauaucuaguuagauacauaagucuugauggagaggaggagauucugaagcauugagaauaaauuugugguugcugagaauggcccucacauguuggaguaaagccagaaacucuuugugccucuucacagcucccacuucccccuaagacucuuccuuccugauaccuauaauucauuuuguggacacugcaggaggugucugcgguccaguuggagguuguggcaaauuguaacgcucaggauggcacagaugucgcacaaggucuuagggagaccagccuuuccuauucaagugcccacagcucuuuccccagcugucaccuuccgcaggaauggccuuuaacacugucaccucaccccauuccccuccacucuugggaagcauacgucuaggugaguggugaagauuuuuauucugaauuuuugaaauaauaucguacugcaaguuccaggcaaucaaaaacucacaaaucacuugcacucugcagcagugguaucaggucugaagaaaggaagaggcugcagauaggcacauggcuuugcuaaguuagcuuuuauauccugcguggcugccuuagaaaguguccuugcccaaguaggcuguggcuucuagauaaaguccuucuacuaagcuaugaaacaugccaauuuauaaauugcuaucacuacuuuaguuccgcucauuuaaaaugaaauagcugaaugccgagugagugaauugggcaucuuuacuuccaagacuucuggggcauucaggagucauauucuaucuaagcuuuaaugguguugguguucccuuuccuuuggccacucaagggagccuguuuucuuuggauaaaccgugaaaucuuuaacccugugaauguccguuuucucuaaggcggggugggcugaaacauaacauaacaggauuuauuuugaaaguggugacuccacaauaaaaacauagauaucuaauuugccuuacaaaggccgauuugcaaaucuaguauuuccagugguucuuucuuucuuucuuucuuucuuuuuuuuuuuuaaugccccauaugacgcugcuuuguuggaauugccauuggugaggaucucacugauaaagaaggggacaucccucccuugauagacuuuaggguugcacuagagccaugcccccuuugaaguggccucuaagcaaacucugucuugucaucauuuuccucucugcagcuguaagugauacggagcuguauuuugaguuuuugauacugauauuacuaaggcaauuggagggauucuuaauucaucuaaaaaaaaucagggauucugacagauaaaaggauuuggaggaaaugucagaauaaagcauuguggguucaugaaguccuagguuuuauaauuaagguuuauaggcagguauuaccgcugcugacuggauucaacugucuggauuggagaugaacaaacugccaucucugggcuaacucugacccacugccugauuuuguaaguagaauuuuuuuuggaacacagccaugcccauuuauucccauuccuauaauguugaacuacuguuuguguauauucaguuaucccaaaauaauauggcccuuugcuuguuaccagaagagucgcccaguuguggcagagaucaucuagcucgcaaaacuguaaauauuuacucuuuggccuuucccagaaaaaagugccgacugcuauguuagauacuccaguucauugaaagugauaucacccuaacauucucuaaauuagccacagcuuagaugaaauuuaggcaaauggaaugccccaggccccaggaagacuguggcagcacauuguauguaacuguuggggauguugccugaaacccccgccuuuuuuuuaggcagcugcaaggauuagaauguugccuccucagaaacuaacacucuucucuccuugaccuuuguuuaaccagcuuucugaaccugaagaacuuuguagauugaaagcuguagcuuguggaccucucucuguggagaucagcaucucaguauccagggggaagccaucucuucacccaaagcuuccgcuaggagaucaagaggcccggaaccccgcaguccugaaugcuaaccaguagagacaagggaggaauucauuucuguuuguguucaacauagacugagcaggaagggccagguguuuuacgacucuuuggaguuagcagcuuguuggcucugauuugguaaaagcaacggaaaugccuucagcacggugaacauuacaugcaaauguugggaaguguuaggaaagggaauuuuuuuaggcgagggaauuucgcauugaggaaggucccugcuucguuuuuagacacagccuaucagucagcuaauuuggcuaugcauauaaauacuuuaguauaaaaugcugcccccugcuaccugcaggcugacauguugcucaucaaaggcaggauccuucuaaugagggauuaguuggaugccuaaaugugggaccaccuacucuguucauugucuuaauuagcuagauguuuguuggagcgcaugcaaauuauuuucuguaagcagacagauuuauuaucauauuuacggagugacauccaggguuugugagacauccauuaaauuuuuuuuuuuuuuuaauguuugagauggggucucacuguguugcucagguguuggucucaaacuccuggguucaagugauccucccaccuuagccucccaaaguacugagauuacuggugugagccacugugcccagaugcuauuagcaaguaugaacaaauuagauauuuucagucuacucuucugugguaaugaugauaaaacuucuuaacuuucaguccuaaaccagcaguggcuaaaacuugauuuuuaaaauuuuuuucagaguuugguccagaugaaguuucuuucaccuugcgaaccuuuagaacgcugggcugcaucauguguguuguaacuuuaaaguuagaauagccuagcuucguuacaguuuuugagccaaaggacccauuaacagaaacaaaacuuuuuuuccugcaaacaaauacaagcuggccacacugguaaauaccagugaaauauauuuugggacugacacuugcauuuucuauugguacuuaugucacaaaaucaccucucuaacguguauuacauggaccuauauauaugcauacuuacauaucaaaauguauauauuuugagguauaaaaaguacgugcucaagguauuggucacuccucaauuuguuuuccuugaaacaaaaugaagguauaaauauuucagccgggcgcgguggcucacgccuguaaucccagcacuuugagaggccgaggcggguggaucaugaggucaggagaucgagaccauccuggcuaacaaggugaaaccccgucucuacuaaaaauacaaaaaauuagccaggcgcaguggcgggcgccuguagucccagcuacucgggaggcugaggcaggagaauggcgugaacccgggaaguggagcuugcagugagcugagauugcgccacugcaguccgcaguccggccugggcgacagagcgagacuccgucucaaaaaaaaaaaaaaaaaauuucaugcagggaaucccaaaauguaauuauagugugauguugaaauugauugucuuagcuuagagagccuacuuuuuaaaacuuagggucuuguuucuaaaucauguguugaaauuacagugugaacuguaguugccauacucuuugauccuacaaauugucaccacgaugaauucauaucuugugcaaauuuuaccaguucuacgugaauagaagaaaauuacuuuuucuucauguagagaaggguauucauuccuaagauuuuaaauccacacuucccaauuauggacuacgccagcuuccuuuacaccuuugcuucuuuguuuucuuuuccauaccuaaauguuacuaaauuuugccuuugagccuaaagcaugucauugaugguuuuuuuuuuucuaguuauuccaaaaggucccauaaaucuggggccauagcuaacuuacauuuagucauuuucauggguaaaacacacucauaugagaucauugcacuugggaucuugaaaugccugauuaguuuccuuucugauuguugaccagacuuaaacuagugggaucuuggcauuuaucuuuuuaaaaaccuggugcucauuaaggaaaggaaaauauucugaaauaaucgaaauaaccuuuugggcauuggaacuccauuuuaaauuaaaaacauuugugccuacuauuaucuuaugcuaaauuauacccagguauuguaaguaaaauuauuuugaaguuacuuuguucuaagaaacuauggagauucuugacaguguuagacaaaguccuuaaaugacauuauauaaaaauugagaauuaguaccuuaugacuuaaccauuuuacacugagauauuauuggacauugaguguacauggaaaucacgugaucaaaguauuugagaaguaaauaucuaaaggaagagaccaauuuaaaacauucuaaugagcaucaucucauaauuugguaaucucauguaaaaugcuuauaauagggguguguguauguuauauauauuuuuaaaauaaauuuguaaucauguauacaguaguccccccuuauccgugguguuucaguuuuuuuuuuuuugagucagaguauuacucuguugcgcaggcuggaguacaguggcgugaucucagcucacugcaaccuuugucucccagggccuggugauucucaugucucagccuccugaguagcugggauuacaggugcacaccaccacucccuacuaauuuuauguuuuuaguagagacaagguuuugccauguuguccauacaggucuugaacuccugacauuaggcaaucugcuugccucaaccuccccaaaugcugggauuacaggugugaaccgcugugccuggcccguguuucacuuuuugagguuucaguuaccugaggucaacaggcaucugaaaauacuaauuuugagagagagagagugugagagaccacauuuacauaacuuuuauacaguacauuguuauaguucuauuuuauuauuauuguugaucucuuacugugccuaauuuauaaauuaaaauuuauccuagguauguauguauaggugaaagcauagaauacauaggguuugguacuauccaguuuucaggcaucacugugggucuuggaacgcaucucccgaggauaagggggggcuacugucagugugaaccugauuagaucucaacugaaacuuuuuugucacaugaggccaucaguugaauuucaugccugcauguagguuuagauuuuaauuacuuuuuuauggugucagcauaacaaaugagagucauacaaacuauuguuuaaugacaaagugggucaaacccauaauuaaaaaaauuaauaauagauuuuuguucuacuugagguuuuguagcauuacguaaagcuugaaaacuuggaaauuguuuuacuuaaaacccaauuaaaauaauuugaucuuuugcuuuuacaucauagaguggcacaauaaaaauuguaauggaagauguuauuuuacauuuuuuuucuuuuuuuuuuuuugagacggugccuugcucugucacccaggcuguagugcaguggcgugaucucagcucacugcaaccuccgccucccggguugaagugauucuccugccucagccuccugaauagcugggauuacaggcgugagccacuauguccggcuaauuuuuguauuuuucguagagacagggauucaccauguuggccaagcuggucuugaacuccugaacucaagugauccgcccaccuuggccucccaaagugcuaggauuacagacacuagccaccaugcccggggguguuguacauauuuccuuuaaucuaaaagcagaaccaucuuuauauauuuuuauuuuuuuccacuagagggcucuguugcccuuugauauaauuaaacaaaagaggcagcauugcaauauaguucuguuccucucaguccaucuugcuuucauuuugguuaaauaaugucuuuuacuuuucuaacauaucuuuuaggucuucuaauucucugugaugaaguucaaacugaagacuguuacuagugucguguuuguuucuuuuucucucucuuuuguuuuguuuguauaaaaugccagggaugaagggauccacuuaauaaaaaggcccauuguguucagggagcagccuguucugccaaaucacacaagggcauguguuuucaugacauuauugcuuuugagugugcuggccuagcaauaauaugauuuuuuuuuccuaaguggaaauuguaauauuuaaguauuaauaccucuguuuaagguucauuuugaacgccuuggugacccuauguuuuuuucuuuguuuuuuguuuuguuuuuuuuuuuuuuguuuuuuuuuuuuguuuuuuugagaugaagucuuccucuguugcccaggcuggagugcaguggcgcauucuuggcucacugcaaccuucgccucccagguugaagcaauucuucugccucagccucucgaguagcugggaguccaggcaccugccaacacgucuggcuaauuuuuguauuuuuaguagagaugggguuucaccaucuuggccaggcuggucuugaacuccugaccucaugauccacccguuucggccucccaaaaugcugcgauuacaggcgugagcuacugcacccgcaacccuauguuuuuuucuaagaauauagugucccuugcccccugcuacaagccuuacccaguguuacauaauuuauuguaauuaaauuguuuauuaaugauacauucuugcuguagaagaaaacguguccuuuugggcucaguacaguauauguuucuuaaguaagagggaucauauuaaaccagcuacuuaaugugaagcagauagccaguguucuccauguacaaucuuagggaggguaauuuuuguuuuggcuguguaauuaugguuugaggcagcccauuaaucgcauauuucagcugucaaauagaaauuuggcccagaaaggaauacacuuuggcuuuacaaaacugcuuauuuucaaauuuuuaaauggggacaaaaacgaauaugcuauauuauauacuuuuauuuauauaauuuuuuuuucagcaacuuuuucucuuuugaaaaugcaagagccugaaaaacauugugaauauacuuguaacauugcaaagcuauuucaccagaguaaagauauuuugguuguucauauacgaguguguucguuguuuaucuaauaaauuguuaaaacuagauggcgauucugggaauuauuauagacuucauaauaaauaagaugcugacaguugaaacccccuugaccguugccuguuugguaugacacagaccuucuuggacuuuuguagccuauacaugaguagauaugaauccucagccuucuccaaaauaagguuggggucacuaggaggccuucuuggaaagaugucuuaaauuaaggcaccaguagauggaucaaaaagcagguuccaauagcucgcuuuuaguuucuugccuaaauuugugaucucccuuuggcuucauaaauaacgguacauuucaugaagagcuggucucagucuacacaagccuaacugaauggggugcauaggaaggguugcauugugugacaagguuuaaaucuaauuguuuuaagucuuugaguuauuugcucaccaggcugugcuugaugguuuuacuuuuugugauuuuuggagccuucauguuagaagccauagucauauggugcucucugaaagcaagacaagguuucuucacuagacucuaagaggagaucugagacagagagaugggggcggggaggaaaccuauuucagugucucuacuauuucuaccuagguggaggauaacuagccagaugaacggagcuaagccuuuuguaugaaguuuauuucauauaaagaggaacaaaaucagaaucaaauuucuucuguaguugcacagaaacugaaguuaaagcuaauacaauguuuuucauuuuuacccuuaccucuacaauguacuuaauuguuacagauucguauuuauugauuaucauguuguauuacauugauagccguuuaaaauuuaugaagauuccguacuugucauauuuaauucucagcaccgugcuuacagcugucuugugauaaugucgaaaggaaagagaagggaggugagguaacgugcuugagaucauacaggucuugggcggcgggugccugcaggauagaucaaaggguaauugagucugugccuggggccccuuccacuguacaugccaccauccuguugggaggaauaacagcacacuccugaaugagcucuuucuaagcagcucauucauuuuguuaauccugaguuuggaaucaaccaauuuauuuaaacccgugaagccucgcucugugcccggucaagugcugggaguggcaucugcggggagggccaaggcagaugucauuuccagacugcauuggauccuggauucagaagcugaagcuuaggagugggcauggugguucacgccuguaaacccagcccuuugggaggcugaggcaggaggauugcuugagcucagggguucgagagcagccugggcaacauagcaagaccccaucucuaccaaaucaaauuuuuuuuaaaagcugaagcuuucuuuaccaaaaccacuuugguauuaugauuguaaaacaaacauuaaggaauaagucugggggaaugggaaguagcauucaucaagcgccuguauaugccagguguuaggcuagauuagcuugaugugccuucucauuuaauauaaguaauuauuuuaaagguuauugugauuaacauguauuccuuauggaaaauuuagaaagcgaagaaaaauaaaaauaagaauaaaagauuuaaaaaaaccccaauucuuaccaguuagaaguauacuauuaauauuuagcauguaugauuguaagcauguuuucccuucuuucgugauuuuucuauuuaaauugugauuaucuuucuguguuguuaaauacuccacaucuuaaauggcugcauaguauuccauuaugugguuccagcucuucucccagugugguacauucgggugguuuccagcuuuuuaauagcuguggaauggagaagcacauuuuguaauuaaauguuuguacccauccgugacucuucuauaguuuuauuuuguggaaguggaauugcugaaugaagugauuugcuccccaaccuuaauaucuugauuuguuuugucaaacugcccuggaagauuguaccaauuugaaugcuccuuugcccagcauccuugccaaacuugagaauuagaauuuuuaaaaaauaucacuuaaauuugccuaucucugaugauuagcaagauugauaggcuuuucuuaugucgggccauuuguuuuuuaacgaauugcccuuucaucuuauaugcaugacuauuggauauguaucgauuacuaauugauugcuugccucaugugcuaucauuuaauuuucaaaaugucccuuagaaguuaauuuauaaagugucuauuacuuuaaguaccuguucaauccugugaucaagaggaaauucacagagaaagaaauuggccuaacuccucaguuugcuucacuaaaaucuuuuaagcacacaucuugucuauuaugccagcugcaacucaaaucaaaggcacuguugcuuugguacccgcauuuaaggagggaauaccccaaaaaacuuaaacuugucuggcuuugcaauggugguggagucccaagaugacacaguaggcaagauuugauuacuuugguuaugcaaauuuccccuagaucuucuauuaaugacaguaacagcgcuucagagcuuuucuaugcauucucucauuugaugagccugcuuucagguggagaaauuguaccauugcugaaaauagcuucgcugacaguuagggcaagcuucauugguagcaaguuucuaucuggaaagauguaggagaggaacacugacucuggaagcagacgugaccuaguuuugaaaccugggauaaccacuuccuaucuguaugacccgagcaaguuacuuuccuucucagaacuccuguuccaccucugugcaauauggacaguacuccuacuuugcaaaguuguuaaagaugggaacuccagagugcccagggaauugucuacucaucauugcaggcguuuaauaacguguagccauuucuggaaugggaggcaagaggaucgaguuaccagugaaauuaguuugguauuuuccuagcuuccugguucccagauccucaagaggcugccauaaucucugugaauuuguccuaaaaugaccuguauaaauaacugcuuuagacacuggcuugucuuugguaugaaggaaaacauuuuagaauuuuuuuggcuggaggucaguagcuuucauccagaaaagaauaaucaacggaaaaaaaaaaaaaccaccgagacgagguuauuuuuguuacagucaaggaacaaaaagggauauauuaaacuugggggaaaaagagaaggaaaacuauuauucuuuaaaaccguuauaccaugcaucaugguaacaucuuuuuuacugagaguucugcauuagcacacuuguucacccaaguuugugauaguuuauaggacugccugguguauuaaguagaaaugcucaacuuugcuguccuauuuuuuugaucauauccaaaaagugucaguguuugaauauaguuuuauugccacuuaaaaagguaggacaguuuuauuggcgucuacuggacaugguaggaagagagcuguaauuugacacagauuguccuuaacuugggugacuuaaggcaagucacuuaaccaucugagccuuaauuuccucguuuguaaauucaagagaauaauaacuucucugucacauacuguuuuguacagaucaaguaaaacaaugugugaaaugcuguaaugaagaaguccaauaguguaugaauauaagguugcuggcguuuggggaaaaaucauaguuauagaagaaagacuccuaaagggaagauuaggguuggaagaagauggaggaagagaguaauuuaauuccuuaauggaaagaauaaaauaagagcucuugacuuuuuuuuuuuguuguuguuaggauauggggagagguuucugcaaauaucuucuucaggguuuacgaagugaaccggauguccgguaacaggguugcaugucaugcaauugacuggguggugaugacuaaaauuuuaaugaugcgaucucauuuaaaguugacaggcucugacucuagccagauauucaggagcagaaacuugauucaauaagaagggaaccugcagaggcagaaacuucuguggguugcaguuguguugagauuacacagguggaaauguugcgaguucuugggugaugcgauuucuuccugcuugccuuaaguuucaccugcccagguccuuacuucugcucacagugcagcacgaauuuagauacugauuggggauucagacacaaacgggaugcuccuugcuuauauaacaucaacagaauugcuggccacaucuugauuauagaaacucuuuuuccuggugaucacacaaagcaaaagaaugaaaauaaucaaucucuuucaaauggagagacuccgcugugucagccaccauuggcuauaaggaugaacucucaaaacuuuuuguaucuugcaauauaaugucuuccaacugccuuugauuuuacuguguggcugugugauacagcaaggcagcuguggcuucuaaauucagcagcuagguuugagaagcuucuaucagcugagagaucaucaguacauuccaaauggcauuaaaaaugcuguuacagcuuuaucuauuagcaaaggaaguuucaauucuaaguucacguacaguuacuagauugaguguuugacaagguagagagcucuguaguagauccauauggggaacaucucagucaggguguggagucagauuuuuggcaagggauaccauccuuucagccugaaaagcugacuugggagcugucagccugugugcacgaggaccuuuuuccucccaggguuagcgucgccacuugcccaguguuucuuuuuuauuuccugcuggccugauccgggagggauuugggaaagcuagucuuguuggugugucaucaucgcgacgcuguuagugauugacuuacccgaguguacacauguuugcaucucacuuguauguuccuuacauguuuacuuaauuauugggaagguguauuaauguccuguugcuacuauaauggaccaccacaaacucggugcuucuaugcugcaaaccuaagauuauaggcagucauaacacaguguuaaguauuuguguaucuaaacauagaaaugguucaguaaaaauacaguguuguaaucuuaugggacugccguugugugugcaguccauugucaugugauagugauuaagggagguggacauuuuuguguuugcuuauuuccauaagcucaaggguaaagcuucccaaucagccuuuaggacagagguaagaacugguugguggccuggagccuggaucuggccuccagauguuuuuuguauggaccacacaaaaauggucuauagugggauuuuuuuucuuuuuuuuuuugucagacuacuugccagcauacuaaaaucaggauauuuuacuuaaauguagauuuaugacaguuuugaaaaaucagaaugaguauuguagacuaaauguuuaugucuuccccaaaaauuccuauguugaaacccuaaucuuaaggucaugguauuuggacaugguuguguccccacugaaaucucaucuugaacuauaguucccaugauccccaugucuugugggagggacccggugggagauaauugaaucaugcuguucucacgauaaugagugaguucucaugagaucugaugguuuuauaaggggcuuucuucccuuuugcuuggcacuucucuuacugcugucaugugaagaaggacguguuugcuuccucuccugccaugauuguaaguuuccugaggucuccccagccacguggaacugugagucaauuaaaccucuuuccuuuauaaauuucccagucuucgauauguccuuauagcagcaugaaaacagacuaauacaggggccucugggaggugauuagaucaugaggguggagcccucauaaguaagauuugugcccugaugagaagaggauagaaagguagcuaacuuuccuuaagcuaugugaaugugagaacacagugggaaggcagccaucuguaacuaguaggagggcccuccccaagaacgugaccaugcugccaccuugaccuuggacuuuaagccuccagaacuguguuaaagaaaugucugcuauuuaagccacucgguccaugauauuuuguugcugcagcuucagcugacuauggcuuaugucuaucaaggaacauaguugcacugagguugaacagagcuguuccuauaggcugacccccuguaggcaggcacaggcuauuuuccauggucaguuuaccugccugcuuccuguagaggcuugagcuugguuuagagucugcaaugaaaacugugugaugauauuggacucacuggcucauagccacugccacgcccuuauucagucuuuugugcaauuaacaaacauuuauugacuacugaguaccaggugcuaagacuucaguguagaaacaggcagggucccugcccuuguggaggauacaaaacacaccaaaaugcagucagcuucacugaaugacagagauaugaucugagaagugugucaggcagugucaucguugugcaacccucauaggauguacuuacaaauccuacgugguauaacccauuauacacagaggcuguaugggauagccuguugcuuccaggcugcaaacuuguauagcaugguaccgaacugaauacuauaggcagucauaacacaaugguaaguauuuguguaucuaaacacagaagugguacaguaaaaauacaguguuguaaucuuaugggaccgccguuguaucugcacuccauuguugaccaauguguuguuaugcagugugugacuguaccagcagcuugaucuuugugcuucuagagaacauuuaaauugauucgcuuuugugagacagggucuugcucuguuacccaggcuucagugcaucagcgugaucauagcucacuguagccucucccuccugggccaagugauccucucaccucagccuccugaguagcuuggacuacaggcaugcaccaccauuccuggcuaauuucuuuuguauuuuuaauagagaugaggucuugcuauguugcccaugcuggucuugaacucgugggcucaagcaguacacuugccucagccucccaaaguacugggauuacaggugugagccaccacaucuggcgaaacucuggguaguuucuaauuauuucuguauuucuauuuguauuuaaaaguacaggauacuaaaauguuuuuuuuuucuuuuuugagauggagucucacucugucgcccaggauggagugcaauggcccgaucuuggcucacugcaaccuccacgucccagguucaagcgauucuccugccucagccuccugaguagcugggauuacaggugugugugccaccacgcccagcuauuuuuuuuguauuuuuaguagagaugggguuucaccauguuggccaggacgguguugaacuccugaccucgugauccuccuacgucggccucccaaagugcugggauuacaggcgugagccaccgcgccuggcaaggauuuuuuuuuuuucauacuugaggaaacaucuaacagcaaauauguucuuauaaguuaaaaagaacuuuugcuauuuugaaugacacucucauuaagucuuacuacuagucucugauuuuucuuuuuucuuuuucuuuuucuuuuuuuuuuuuuuugagacagagucucacucugucgcccaggcuggagugcaguggugcuaucuuggcucacugcaagcuccaccucccggguucacgccauucuccugccucagccucccgaguagcugggacuacaggugcccgccaccacgcccggcuaauuuuuuuguauuuuuuaguagagacgggguuucaccguguuagcaaggauggucuugaucuccugaccucgugaucugcccaccucagccucccaaagugcugggauuacaggcgugagccaccacgcccggccuugauuuuucuuaaccuuuauuuccaauuaugcaucuucugaguaacuauaaagaaaagcaaaaucuacaguagguauggagugagugcagagucaccaucagcuugaacaaauguguguaucuguggucaaguuuaauugcuucuucuguaauuuauauuaaucacgcuuccauugcuugccuuuuguuaauacguaugcggccaugugaugauuuuuuaaaaggucauccaguaucuugauguccaguccaugcuuauaaccugagcaguuuauguacucuugagaugguaugugcuaaaaaugaguagcuagucugaguggcagccuuacccauuuuauuuugugggcagauuucuuuuacaguucuggcuggguuucuuuuaguuggcuucuuugcuuugcuccuguuacgacuuagcccuguagcucugggcucuucgauucucacgugcugaugguguagcugagcucugcuaaugcugguuauuaaucugacaaucuauaccagggagguuuuauaauugccauaauucuuauuugcuccauuccauuucccagcuucucaaaugggguggcagcugcaaagcacaguauuugaacaugaaguagagaaucgucacuucagcuuaugauuuuacauucugucaaggcugcagggaaagcggucauguuucuggaugguauuuggaucuacaaauuccaagcaaacuuuuuacuucuuauuauguaaaauggaaggguuagccaaauuaagaucucaccaucaaccuugagggagugacuucuacaugccguguauuacugguuauaaagcuagucuuguuuggauugaagaauuuaaucauauuuaacuuuucaaaggaugcuuuuuaaaaaaccuuauccgcguguuauguuuaaacugagaaguaccugaaagugaaaauuuuauuuauuuuuacuuuuuuugaaagauggagucuugcacugucacccaggcuugagugcaguggcucaaucucggcucagugcaagguccaccuccuggguaaaggagauucuccugcuucagcuucccaacuagcugggacaacaggugugugccaccacguccagcuaauuuuuguauuuuuauuagagacgggguuucaccauguuggccaggcuggucuugaacuccuaaccucaagugaucugcccgccuuggccucccaaagugcugggauuacaggcucacgccaccaugccuagcugauuuuuguauuuuuaguagagaugggguuucaccauguuggccaggcuggucuggaacuccugaccucaggugauccacccgccucggccucccaaaguaguggaaucacagacaugagccaccaugccuggccugaaauaauuucaaauuaaccccugaggaacaaaugcucaugacuuucaaugaauagaaaaaucagacugcuagaaccuccagacugcaugucaugcguagaaguagaauccuggggaagcuagcucacaaaagcaagggagauaccugcaaggcugagcugagcuugcaagggaagaaaaauauuagagaguugucacauuuagaaauaagugauuccaaauuuacagucaauggacuguagaugccuuccaucuucuuaagagauuuugugccucuugcacagguauuaucccuaagauguguuuucuucaauguaccuagacuguuuccuuaaagaauugcuuuuguaugguacggcucuaugugucuguguuucucauguugguuaggagaacuaacccuugugacgaauaagaaauggcaaacauuguuaauguugacuuuacuaguugcucaaauauuagcauuggauuuuagagucaacaugcuagcaggauggcuuuauuuuaaaaccaugugauagaaagcuaucugcuauuauugauagcauuucuggauggcugucagaagucuuucuuuagaaauuuaaccauauuuuuaauggugggcauugcagucaacaauaguacagacuuugcaaagacuauuuuuuuuuuugggugcagugaauacuucgcaaugccugcugaauuuuaccuauucuguaagucuuuuugggaaccguugagccccucuucucuuaguugccuuuagccuuuguuuuuauuaugacaauugguaugaaauuuuuccuuuucauuacuucuuuuauucagagcacaccucuggcuuaucucuucauucucuguuuaguuucauauuuuacuuuaauuucuguacaucaauaucugccauuauaguauuuaagcucuuggaaacaucaggcauuuguuaacuuguugagaaaauaaagcacuccacuguuguuaugagcugcuuauggcaagugaaaaacucacaauauuuggccaaacuugggaucauuuagguguuguuugcaauuaauggcaggagauauuuuccuuguuguuaagaguauaacguugguuuuagaaagcuugaucuauguuuuucuccauguuagaugugaaaagaaccaggagagugugaggauauugguaauauugucauauggugaucccacuguggauagauacgcaagagagaaaauccagaagaaagcauuucacugaagccuggggacauuucuggugacaaauggugcugauggcacagugagaacgggagagggcagaagcaaugcacagauagaaagggugucaccugcgcauugaaaaaucccagugccauaacaaugcagucccugcaauacagacaaaccugacucccaccauuccuguaaaugaagauggggccuugcugagaaauagaggaugcagauuccacccucaggcuucccgucuugggaugcagagaaaacucacccacgugcaacaacucaagagucguuauuuaccuagcaaaguguucacaugacaguguuugaaauguaccacgugccuuuucauguuuaguuuagagcuugacacuagagcucuacugugguuuaccaagugugagggacuauuucuuucugagaaggaggggaagcuuuaguuuccuugaaugucuaauagagucugaguuuccuuuuagaagcauaaaagacguacaguaggcagaaucuggauuuuuaacuauacaguugcugaaguuaucuucaauucaaaucuucuaaauucaauuuuguuaauguuguuuagauauuauuauagaagccagcuuuacugacuucugcacauuuaaucauaggagauucuuccauucugugaacuuagauuucuuuuuucuauccaugacauuuaucuaaaucaggcuuucuuuucuuucuacuaaauuuuucaauuaccaauaggcuaugagaauaauuagacugacaguauuacugaaaaaaaaacaaaacaacaacaacaaacaacaaaaaaaacaccuuccacuaaaacugacucaaaaagauaauagcagggaaaaugacaugucgaucugugauuccuuuuuuacuugucaguccuuuugggaguugaacauauaagcacauguaccucuaugugacuuuugagacgucuagaauagagaauucaccuuuguagcuggaauuuauucagcaugcaaaugugggugggugauuguuuuauagaugccugguguugaaugaugggcaguugugauaacuauauauaaaauuauauuaaaguccaagaggugcuuuuaugaggcaggcuggaaauggcauccgauuuucuuauggcuuuuucauguccauuuugaugaaucuauuuauuacuucuauaaugaguaguacacaugguugguuagccaaguuauugaacuuuaucaaccuuggcugaaauucacaaugcgugccaaacuuguuguaacauguaagaaauuacaucugggcuaaaagguucaauaaugauuacucuuauaauggaaucuucuacaaagcaagggauuucaugauaucccuaugcuuuuaaaaaauuauugugauacagugaaacaaggaagaacguguagcuggaaaaauaguauuugcuuguaauauacauucagauucauaacaggcuuauuugauucccaggacagggugagcaaaggaugcuguuuccugggugucugcuuugguguucauugagucaugucucucucuuuagaccuuacuggaucuagucuucaucauggggccugugagcucuuucaaaucuagaggacaaaaccuaauaaagugcugucauaucacaucuguuuaugaguuucaaacugaaaugaaauguguagccguguuauucuuaaauuacagagacuugaggaacguagagcuuuuuacucucacuagagaaaucuaagcacagguugguucguuaaccuguaaagagauguuuggguuuuaagaggucuaucaaauaacacaguuucccuuucccaaguuacuaccuaacugagcaguaagaccacccauuaggcaaauggaagaccaaaacaucaccugagucauucaugaagcugauacuggagaauauguauagcugugugagcuggugggcuuucuaauccugaccaccacaauuagacaggguaaugggucagugcuaggucaggccagaccuucgcagagggcagaccccauucaugcagcauguucaagacagugcaggagagcagggugugugcucucuguaagaggagaggagaggcagagcugcgugugcccgguucucaauccuggaauuaccauucacauaccauucacaacauaaguuggaucagcucccuugagcaggaauaagugaguggcagagggggucagggauguuaacgcaaauggagaucccuucacccagaaagacacaucugaaauggagaagaugccuuuuuccuccugcaaccaauaagagagugaugaaaauuaugacgccuugggaaauaagacugcaacguaaauguguguccacccccuaguuuucuuuuggauugugaauccucacccuccgauaacuagacgugcuguuuugacgucuaugcuuuccagcuugccaauucuggggccuggcacaguaucuuucaccccggagucucaguuuccucaucuguaaaaugggaaccaugacgucagcaucacagaguugugagaauucgacaagguggaaugaaagcaacuaguguggugucugaccgcuuguguuaguccaugaggaauuuccuuacguauuguuuugugucuaggaccaaguucuuauuuucuucuuauggaugacuucauauauaugccgccacagagggaauuaccguuuuucuuuguagguaaaaaggagcuggguuaagaugcaccgucauaugaaacagggaaaaaggguuugcuuggguuuuagauuccugaaacagucugcugagggauucuaaaguuguuguggucucuguuccacuuugggaguuugauaaaaauuggccuguuuuauuugacagcucuuagguagugugcaaaauugucaacagauaauaaaaguuuuuugcaaagcuauggcucuaugugcuguacuugagcaguauccauacucuuaauagaauugauauaugaaagcaggucuuuuuccuuauccguuuagaccuaaaucuuauccauaguguguggauaucacaaacagcacaagaggaagugaaaggaacagagugggugagcaaaccauuguucaaaggaaacagaaccucgcucaaggaaaaugagaauucuucugaucagcuucuauaauggaugcaaugaggaaaguugucuagcagacuguucuuggccaacugucuaaauggcucgcugcauccucuucacgagagcugaugguaggacuguagaagagucacaaaacaucacaugacaacgccagucccucugauaauccugcaagagccagcccaguuuugcugacagcacagucugcuguuuaauuauuguguguucaaugacuuaccucuuuuuaguuuaauuaaaauuauuucucagauuaagagccaugcuaugaugcuugccaacggauauuuaaaacauguaacugauuuguuuuuuauaaugcuucaggagaacucaguugagcaguaaagaugugcucgugaugugguuagcucagaauaaggaugugaaaaccaaaagggaaaggaggacaggagugaaucuggcacuuaucuuucaguggggccugagugcaaauucuuccuaccuuccauaugagagaauagggaaaauuaaagaauaaaugucucuggguuuaaugcaacuuuacuaaggaaugaaaguccgauaagaauccauaucuuuugaaagaagauuuuuuaaauuccuuauuuuuccuuucugcauggucauaaaacacacuggggacagcccacccugagaagucaccaggcaucugccugccuucaguagcaaucacccaacugcuguagaccguaaucaagcuuucaagaaccacgugcagcacgcugcgggagagucccagcgaagugcuuaaugcgccacuccacggaugugaguggggagcaagugcucaaaauggggcuucugaauugcaaucaucauuuggcaucucuauuaccuacagcugcucaaagauguuccccccaugcaacuguuucuugcaacuccuaacauuugcaacgaggccucugaugcagacaacccguuuauaccucugggugguugaaaccuucaugguuuguuguaaagaaagguacacagucccaccaaucagaccguaucuagaauauuacguucauuuagggguggcgcauagacaggcuaaaggauggcaaagucauugggucauguccuaggagcaacccuuaaaggaagagugaauggcugguuaguugguagaagaaaagauuuauguaaauuaguucucucaguagcuaucuaggagagagauaauccuagcuuucuucaagggacagaaccaggaccaauggacaaaaucugcaaggaggcagcauuuaacugauuagaauugucgggggugggguuggcgagaggguguugcuuuucuaaugauucacauuguauaaaaagcagacaguaggucuggcacuguuggcucaugccuguaaucccaguacuuugggaggccaaggcaggugaaucaugaggucaaggguucaagaccagccuggccaacauggugaaaccccuucucuacuaaaaauacaaaaaauuaguugggcguacuggcaggcgccuauaaucccagcuacucgggaggcugaggcaggagaauugcuugaacccaggaggcggagguugcagcgagcugagauugcgccacugcacuccagcccaggcgauagagugagacucugucucuaaauacauaaauaaauaaaaguagagaguaaguuuucuguauugaaaauguuuuaagaguucuuugucuuaccuuagguuccuccaaaaacagaaccagagaaaaagacauauuuaugcauaauuugggaugugauuacaaagagagggauggggaauucaggaaggaaggagaggcaauauaaaaauguguuuuuuaguuagucauuacuagaggcaacuagugcucaacuccaggcacuuuaggaaaugcaucucauagcugucugccugcggaauaaagggcauuuauccaccggcuucugaccccguuggacaagggcgucccauaaguuuugaugucccagaauuuuggguuugcacaugugcaagugccaagcagguucuuguaggcaucccaugcugcagagucagagaaucucuaggauggaaauggggggauccauauuguagccccaggugaggccaucugguugcauuugugucaaguugguugaaaacugcauggugagcguaaaaaugguuugaguaaaauggagcugugagaauuugaaggggugcaugagaggugcccgauacaguccacccccugcaccaugcucaggucucuuaagaguaagcagaaucuaccacaguguauccuuaaaguuaaaaggcucucugaugggacuauaaaugagucccaguuugaugaauucuggggcuuuagccuuuucugcugugguauuaguuuucuggggcugcuguagcaaaguaccauaaacuggguggcuugggacaacagaaauuuauuguuuccaaguucuagaggcuagaagucugaaaucaagguguugguagggccauacucccuuuaaaauguguagggaaggacccuuccuugccucuuucagcuucugguagcccuagauguucauuggccuguggcaggguaauuccagucucugccuccaucugcacaagccauucucccuguaucuuuucacaucaucuucccucuauuacuguuugucucuguuuucugaucuccucuucuucuaagggugacaguuuuacugggugagagcccaccuuaaugcccucaguuuaacucgaugaccucugcaaaggcccuguuuccaaguaaggugacauucugagguacugggcuuaggacuucaacauaucuuuuuggggggacacaauuagaccaauagcaacugugcuauaaaagagauguugcuuuuuaucauugaugcuauccagaugcauagcaaucauucaacaagucauucgaaagaaauagguauuuccugagggucuaguauguaacucagcucugcucuaggaccuggugauuacagcagugaacaaagugcuccugccuacgugcagcuuacuuucuuauggagcaugauuuucagaaguaauuguucuuuugccucguuaucaucagacauuaggaaccaaggggggauugccugcuuuuggaucacagagcaagcugccuugagcaagugaguucgaauugcaaagguguuuaagcauagcuugguggcugcuuagugaggauguugcagaggcaauuuaaaugccgagcagggcuuuggguuugugaugguuaaaguccauuuccacugcggagaugguaugauuguacaaauggacagguucugggccucugucuguuuugucaaguauacaacacuucuguuuaucuuuaaagggaacaaauaguguuuucacaggucucugcuuaaauaaaaagauucuagaccacuggaugucaaccccaccaucccccuucuuuuuuuuuuuuuuuuuuugcauccuguacuccuuugagaauauaguggaaccucuggcccauucuacaagggaaaaauaaauguauuccuagccaggcauuuguguacaauuuuguaggggaggaaaggauuguucauagacacugaauuaagaaaucccuacacuuuaugggaauuguaaucauuaguagcaguuacguagacauacuuccauuaaauacacauacuugcuuuagagaguguguuuauucauaaaaauucauugaauaggauuaggaauaaaaauaugcauagaaauauuuguuacuuuuucauuguaaugguuuuuuuuggauagaaauuuaucaguguguaauuaauaaaguaguauugauuucagaauuauacggugcuaaacaauggaaauuuccuaaauaacuggcagguaauggaaaaaaaauucaguuacugacagccugucauaguugaaucuaagagcuaggggcaaaauacauauauucuauguaguuuccauuucuagacccuggauuucuaaauucuuccuuauaaaauuuuaaauuucuuuuuuuuuuuuuuuaaagauggugcucccuaacugauuuccuucauuuuauuaucucauaacagauuugauuuucacaaugaagguaauuauuaaaaugcuuccuuugguagucaauaaauauaauuaguuuaagaaaacuagaaauauuuguuauuagaauuaggugaacaucuaagagucuuauuuauggaagcaacauggucaauauuuauggaauugaguugaggcuuugcaacacuuucaacagcuuuuuaaaaagcaaaauaguuacugccucuguggaaauagaaauuacccaccuauuauguaaugaaaaacuaauguugguuuacuuaaaacaaaacuguguagcaguguguuauagccacaggaacuccucagccaaauguuaaguuaaugcaaugaaaacauuuguaaaaacauuaucaagcugcaaaagaacuagaaaugcuagauacucccuaguagcuggguguucaaaaacacuugucauucucacaguuauauuugugguaucuuaguggucauucaccuuggaugugauuccucaaguaugccagaaaagcaucgucuugugcaaguguuguauuuaggaagaacuuugugugaaaucaugauugugggugaauaacuuuaaauaaauaaaucguuuuccuugauauacaauauugugcuacuuuccacagaaagauggaaucaaugcucuugacuguaauggagguuuacaguuuuucuaauuucuuauuuaggcugaucugagcaaagauguucaaauuuccacuuauuuaaacaagauagaguuuuugcuauguugaaggaauauuuuuagcuuaguaauuuacuuagaaacugccuuauucaauauucgauguuaaauuugaacuaaaacacauagcaucauaugacauggagucuuacauucacauuuuguuggacuggaaacagaaucaacauauuagucaucuuaauucauuuaaguuggcuuucuccagaauucuagaauccaaaaacaacacauuugucaguuuuacacacaaaaggagaggcaggauguaguuuauaguuaaacauccagcuuugcaaugaaaagccaauguagcuauagcacacugaaugaaauucugggugaaacaaacuguguaauaagauuuugaugcauauugaauacuuagaaaauuuguuuuauauuuguuuuaaugagauucucuuuauaucugcuuucauagaaacuuguaaauugucuaaaauuaaauuuucugugguugucauccacauggguucugaacuugcuguuauaauuauucacauuuucuugcagugaaaaucuacagaucaaggucaucuucacgucuuuaguucuuguuuugcuucaggucaguuuagaaccgaauguuaaaaggauauugucuauucgaagggucagauuguggcacguggaccaaauccagccccccgaggcccacuuuuguaaaucagguuuuauuggaacacgggugcucaucguuuacauaucgcccauggcugcuuucacaucauaacagcagaauugaguagcugugagacccuauggccagcaaagcccaagauauuuacugcauuuauuuacuguauuuauguuuauucucuugcccuuuacagaaaaaguuuggcaaccccugguuuauucuguuaacauguuuccuauauaaggauuccucuaauaaguuuucagaauuauuaagaaaacaaagcucauuccucuaaaagaauugguauguuuuuuuuuuuuuuuuuuugguggugguuguuuaaugaggaggacauuauaaaguauuauauuucguuuccuuaccuugguugccaggaagcucagaacuuuaaacauuaaaauguuuaaguaaccagcucacuucacguuucggaucagcuuucuuuuucuuaacacggggauacauuuucacuuuaaaaaaaaaucaacuuuuugaagcauaauuuacauguuguaaaacccauacauuuaaaucauacacaugaaggucuugacaaguguguacacacacauaaaccaccaccccagucaagauaauagaauauucacaucuguaagaaauuuuccaccugccccuuggcucaggcaauuugucagucuuacuacugauuauugcguuauuuuaaaacccuggguuguaugcaauugucuauuacaagcuguuuuaaauaguuuucgguaguggcuggggcacuaaugauuaauaguugaauagcacagcuggagaaguuaagauucauuuauucuauuuagucuucaguacaaauuuuuagguuuccaugggagaaucugagauacagcucacauggagagccuuuuagcuaauguagcaauaauuaauaagcuggauagccugauagccugauguuuuauuaggguggugcaaacgugguuuuugccauuacuauauauauauauauauacacauauauauauauacacacauauauauauauauauauacacacacacacacauauauauauauauauauauauauuuuuuuuuuuuuuuggagauggaguuuuacucugucgcccaggcuggaguacaguggcgcgaucugagcucacugcaaccucugccucccagguucaagcaauucuccugccucagccucccaauagcugggauuacaggugcacgcuaccaugcccggcugauuuuuguauuuuuaguagaggugggguuuugcuguauuggccaggccagucucaaacuccugaccucaagaaauccgcccaccuuggccuaccaaagugcugggauuacaggcgugagccaccgugccuggccugccguuacuuuuaauggcaaagauaauucuuuuaauaauuaaaauuugaaauaauucuuuuaauaagaauuugcugcuugccaagagcucugcaguuauuuuauucaauuuuccuaacagcucuuaagaguacaucuuauuauuccccuuucacagaugaggaaauugagguucacagaaguuaagucuauuaguuugcuagagcugcuguaacaaagcaccacaaauuggguagcuuaaacaacaaaauuuauugucucauaguucuguaggccagaagguugaagucaagguguuggcaggguugguuccuucugaggacugggaggagauaccuguuacaggccucucuccuuggcuuguagaugaguguauuaggguucucuagaggggcagaauaggauaggugcauuaauauuuaugaaggggaguuuauuaaggaguauugacucccacaaucacaagcugagggacaaggaagccaguuugaguccucaaaccucaaaaauagagaagccgauaguguagccuucaggcuguggucaaaggccccaagagccccuggcaaaccacugguguaaguccaagaguccaaaagcugaagaacuuggaguccgauguuccagggcaggaaggauccagcaugggagaaagauaaaggccggaagacucagcaaguguguuguuccaucuucuccugccugcuuuucucuuggcucgcuggcagcugauuagaugguaccaacccaaauugagggugggucugucucucuucauccgcugacuuaaauguuaaccuccuuuggaaacacccgcacagacacacccaggaacagcaccuugcauccuucaauccaaucacauugacacucaauauuaaccaucucaguaggcuucuucguguucacauagucuccucaccgugugcuguguccagauuuccccuuuucauaaggacaccaguccuauuggauuagggcucccccauuaugaccucauuuauccuuaauuaugaccauaaaggccccaucuccagaugcagucauguuggggguuagggcuucaguguaugaguuugggauggcaggggagcaguucagcucgugagaaucguaagauuccugaucuguuucucuuccaagaaauuguuugguuucauguugauuuuaucuccuuuucccuaucugucucaaagcacugaagaaaaucaagucccccuugcccugauaaggacuuuaaaaugguguuugcuaaaauggugugugcuuaggggcagcuuugagccagauaacaauucuaguugcgcaugcuuccauaagcuguuuacucuaggaaggagaaucucuguugggaucuuuuggggaguacuugccucccaagugcuuaggcucccgcugcugacaagacccucugccuggcaagccgugcagguuggaauccucuguuaggguuccaaagccuucaccaacucagagcucuuucucucucuguuucucuuuuuugaauuuaaauugauccuagucacaauguucacauuaccuauguuggggauccuaccaagacccucuuuuuggcccagaagcagcagcggggugaggggaaugaaacaaaaauuuauagcugucgagucuccagaagucauguaaaaucagccucagcuggaagcuccuccgugcaucccucacauucacacaagcaggugccugaucacagcugaugguuagauuacacguuuccugagagguauagauuucaaaauugguguauuucacccgucccucaucaugguauccccaaacaaaauguuaucaaaugaagaacuccuucccagcucucccuucugagugucugauuuuauucaagcucagauggcuucucagauagcguaaaaagugauggagaauuucuuuuaccaauuguaugcccugugggaaccugggugcuguaaucacugaauauguuauaaccaaaaaggucaaacucgcaaugauucgguguguuuuguuccgugcauccuggcaugugaaagaagugagguaaagaguauaauuuacuuccuuguuuuaaagcuagcauugcccgugccuuccacgcgggacuguuguggauauuugaccacugcaagaaaacucacagaagcagaaacuuagggcuugcuuuaaauguuaucagugugaauugagauggugucagcauuauuuuuuuaaagaccaaaacaacaauaguaacaaacacacacaagccacuguuagauuuuacaaaacuuuaaaaaguaauuaucuuaaagauaucuaagauagugaucugguuacauagauuaucagagauacuuuuuuuuuugauuaucagagauacuuuuaaaaaagcaacuacaagguaaggauuauccuuuaauuuaguguuuuucuauuaaacucaauuugcuuuaaaguuuuuuacauuuugccucuuuuuuguauguuugaguaccacuuccuaaccaaucacaauaaauguccgguuuggaguuggaggagucauugauuuuaggcaaggugauggugagcccacagagcacagaguuaauggaacucuggccguugauguagcuucgaagccugaauuuaagucauauuuuugaaaaguugcgucuuaaaaaguuacuagcgauggagaaugaaaagucaauuuggacacuuuaaaagugagccucaaaaaacugcugaauuuucccaacauuguguuuugagcacuuccacgugacuuugguagcauaaagacuuuagucuuuucaagaggcaaaguaauauaccacuuuucgcuuuuuuaauggugagagccaaggucaaucugaauuuuucuuuuucuuucuuccuuuuuuuuuuuuuuuuuuuuuaaaaaaaaaaaaggugcuugaauuagaaagguagcacauuguccacauggacagugcaggauggggcuggcuuuuucauuucugagagcuggcaauggaaugaaggucuuuuuuuuuuuuucuuaauuuuucuuuuuuaaacaauucccuccuaagcauuucuuaauugacagggguggaaacuauguugccaagagggaucacagcccuuuuggucauuaagaaagucaaggaacggggucucuuuggaugagugugugcguguagaauccugguggcuggccugcuugcucuaaaucauaaagaacccugucucgagcagacgagaaagaguaacggaggccucaauggugaaaggaaauccuguaccagcugugaaaacaaugagacacguucaguaauagaauauagugugcuuacaaauucagaguuggguucccuucuucucuugaaguggcuauaaauuaauucaucaaaauaaaaaaggccaaacuucaggauaaaucuuucuacuucuaaacaaccagaaacacuuugguugucuuaguagauaggagugugaguacagaauuauacgaagugagaccaugggugugugugugcacgugugugcgcaugccugugugugucauugguuaguuaacaaaaggauugcccucugaagaacaugaacuugggccagacagcacguguaggggguggaauuauggagcaauuguuacuuucuuguauuaagaagaaagggagcaaaagagcugugucuucuugagaaccuuuaaaagacacagaggucucugccucuaaaaagcuccauuacauuuuuuuuuuuaacaggaggccuaaauuuuuuauguuuuauuuugugcuguuuuauuuuucuuccuaagguucucagacaaguuuauaaaagugccauguuggcugggcagaguggcucacgccuguaaucccagcacuuugggagaccaggguggguagaucacgaggucaggagaucgagaccauccuggcuaacacggugaaaccccgucucuacuaaaaauaacacaaaauuagcugggcaugguggcgggcgccuguagucccagcuacucgggaggcugaggcaggagaauggcgugaaccugggaggcggagcuugcagugagccgagauugcgccacugcacuccagccugggcgacagagcaagacuccgucucaaaaaaaaaaaaaaaaaaaaaaaaaaaagugccauguauauuuugauuacaaaaaauuucaugcgguguuacuuucuuuuuauugguagagggucuuuauguuuuauuuuuuugagacagaaucugcuccaucacucaggcuggagggcaguggcaggaucguagcucacuguaaccucgaauuccuaagcucaagugauccuccugccuuggccuccuaaagugcugggauuauacuuugagccacugugccuggcuggccuuuguguuggacguuaauacaguugguucuuuaaaguuugacagugaagacuuuuggaaauuaaagaaaaaaaauugaguauaacuuguaacggucaugguguaaagaucauuuuuuacugguuggaaguauagaagugggguuaaauuaagucuauaauuguaaacuauugauguuggaagaacauagagagaaacuuauuccuguggacuggugaucccaucucacagcccuuacagauaaauguuuguaaaagcaaaggacaguguuaauucugagccccaagaugaaauaucaaguaaaagagaagaacauuugccaaugcaucacugucugggaauggauuccauacagcagguagguuuauguaauacaguagcugaagagaccucaauucugugccuugaugggauuacaccgaagggagcacugguaggcuguugaugaaacaggugguauuuggaccacuucucccucuuuccggacagcugcuuaguagguuuagcuuaaauuauacacaugccaagcauguacacauaugagaagccuauaucucguaauauccacagagaauagauggcaaaucccaugauuuguauuugacugacagucaagacccuguggggugugagccuggugggggcauuccaggcugguuucuccugccuccaggagcugcuucuagugugugcucuuaacccuaaaggaaggaaacacugugucuuccucuucucucauacagagcccuucccaugacaaauguguggaguguucccuccuuuuacguaauucuccaauuuucuggaccccagcuugguguccuacaauucaguuuugacacuaacgacccagagucagcacagaccccaugguugagggcucaguccuacaggaucauccccuacuucaaaugccaguagcaaguucaagauugucaagugcacuucugacucacuggcuacaaauugggguucccacgaccaucuccucaggcuugauaauuugcuauaauggcucauaaaacucagggaaauauuuacuuauguuuaccuguuuaugauaaaggauauuacaaagaguacagaugaagcgguacauagggccaggcaugcggaggggauguggagcuuccauacccccucccggcaugccccucuccaggcaccacaugcucagcaaucuggaagcucuccaaacccuaucguuuagguuuuuguuguuguuguuuugagauagggucucgcucuguugcccaggcugcagugcaguggugcaauuaugcaaucauggcucauuacagccaggaccucccaggcuaaagccauccuccugccucagcuuccugaguagcugggacuacaguugcacaccaccaugccuggcuaaguuuuuuuguuuuguuuauuagagacgaggucucaauaugucacccaggcuggucuugaacuccucagcucaagcaauccuccugccucggccucccaaagugcugagauuacaggugugagccacugugccucuccauuuaggauucuuagagagguuuuguuacccuaggcaugauuacuuaaaucauuggccauuggugauuaagucaaucuccagccccuccucuucccccaaggcggggaauguggggguuaucaauuauucacaacucucuaauugugaauaauaaaagacucuccccucacccacauugcucagaaaauuucaaagguuuuuguuuuuuuagacagggucucgcucugucacccacccaggcuggaguguaguggugcagucauagcucacugcagccuccaacuucugggcucaagugauccucccaccucagccucuugaguaacugggacugcaggugcauggcacugugcuccacaauuuuuuuuuuuuuuuuagagaugggaucucacuguguuguccaggcuggucucaaacccuuggguuuaagugauccucuugccucagcuucccaaugugcuaggauuacaggcaugagaccccaugccuggccaauuucaaggauuuuaggagcucugugccaggaaccuggaugaagacccaguauguauuucuuauuauaucacaauaucacaaauccacagucacauggugauugugguaguguggggggccugauggugggguacaccugcuugaagucaggcuaccaugcccauugggguccucccccuuuuuugcccucugaucuugugaguuccuuaacauuggggaucagugguuuuucucuuacaugaaaugacaaugacacuuuauaggguuucuguagagaauaccuuagaauuaguuaauguguuucauaaagcacauggcgugguacccagccaagaguaacacucugaagugcuccuccuuaccuggacauuacagcauccuuuguauaaaucaggaugcucaggaaauaccuuguuuggaauaggaauaggcuccucccuuuuuuucucacuugccuugauugcucuguauuaaaauucauaaaggcccaugaauuaucaauuagauagcauuugguuuguuauuuuuaguuucuuccuauagcaggcauguaugcauguguuaaaaauggaaguagcgucgacauuaugaaaugcacaagaaguuuuccugcccccaaccgguaacucucuccugcaguaaucaauguuggcaccuguuuaaccacuuuugugucuuacgugcacgcuguucgguacuuugacuuuuuuucuuaauauuauaacauggaggccaggcgcgguggcucacgccuguaaucccagcacuuugggaggccgaggcgggcagaucacgaggucaggagauggagaccguccuggcuaacacggugaaaccccgucucuacuaaaaauacaaaaaauuagccgggugugguggcgggcgccuguagucccagcuacucgggaggcugaggcaggagaguggcgugaacccgggaggcggagcuugaagugagccgagaucgcgccacugcacuccagccugggcgacagagcgagacuccgucucaagagaaaaaaaaaaaaaauuauaacauggaaauguuuccuugcaucuccguaucauuucuccucauucuuuuuagguguaacacaguauuuuguccuauucaugcaauauaauuuauauaaccuaauugauaaaacauuuugguugauugcagucugucguagauaaugccguacugaauauuccucccacauauuugcaagucuauuuguaggauaaauuucugguuguggcugggucaaagagcauguccacuucaaauuugauagcuaugucccaacugcccccaaauauguuaagccauuuccuaucccccaucccucauuaaucuaugaaguugccugguugccccacaucuuuaccgacaggacugccgcucaauguaguuacccuuguagaaucugucugcaugugccugucuaggaccauguuaauuguaaucuuugggcauuuuucucacucauuccuaaccaggacugucacuggcagguuaaaugagaacuuauucacccagcacaguggcagcacuaguagccagccuggggucagucuugccucucgagagaucucaugcagucaacugggauuuauuguacagcuuuacaaaacauuacggccucagccuuguacugcccaaagcaugcagaugccgccugguguauuuuaaagauauuccacaugaacugacccguuucccacuucuugaguugguauguuuuuugauuaauauauuugagauguauuuauguuauuagggcuauuuaggaagcucuguagggauuuguugcuugcuguauauaacacauacuuuuaaaaagcagggcuggcuaugacuuauuuuucucuagagagaccuguguaguuuuguaaguucuuaagauuuggcagcuguggaucguguuuaguaagcacgaucucuaacucuuuggaacucagaacuauguaauugaaauggccugggaggcaaaugugaucauucagguaaucaaaguaacuacagaaacagagguauggauuagcuagucauugcagauguggcauugagcauauaggcgugguguacuucuuagaacuucaucuggaaaugccugugggggaguuggauuucaagaucaucgucaaugucaugucacuguaauuucauuuacauuaaucagauuaguuuggaaaguauggucuuccuacuuuuaggaggauauaggagaaacucauccuuaaagauaguagucuguuaauacaaaaacaguccccacauuugcauuguccccaaaucuaacccaagcugaaagacauuaggccuaucuucuugcuuuaugcauaauggcagaucuccagggagggagaggaugugugcuggaagauucuacaacuuguugauugguuccuaaagaucguuuuagugcuauguuuguggggcggggcuggagggggcuggaaaucaccaucucuguggccuuuuaauugugcccaguuacaaguaacauuuguccccaguguuucacaauuauaaauuaauaauaaccacccauuagaaauuacggguauuguaagccccaacuccuuugggcgucuuaauaaaaaugauaauuaaaaccauaauuuacaguaaauggggacacugcccaaguacauccacaauauggagaaaauuaaaaaacuuaaaccagaaggaaccuuccuggcaucggggaaagaagcugccuuuuucuuagcuccuaccucugugggagcuuugucaguauuugaggggacaggguucccaccuucauguuuuuugugccugaggauucugugggcgacuguccccaccuguccaaccuaccagugagucucauggugugcggcugccugcuccgaugcucuccaccaccaugcccaagccauuucucccuuuguguucccugucuggguaaacaacuugccaagcucaccaguggcccacagggcaccuuggacaccuagacuuaggcagucccuggcuuuguagauuuuuuuugcuuccuacaugauuuucuaauuuauaccuugagcugcucgggauaagagggcaccucguccauuucuggcuggucacaaggccacaguaucuugagcgaguccauugugaccacuggagguacuguaaauggauaaaauaauaauaugaauaauaacucauaguguuuacucccugccuaaauccacaggcucccgcugccuacagaggagucccacaguuuucgcuugcuucauggagcuucaucucuguuguauucaugugauuuauuuacacagaguugcuccccaauccuugaucuuuuuuuuuuuuuuuuuuuuuuuuugccaagcacccugccuuuuugcuugucuguuucgucuuuaucucuccuuccaguaaaguucuuggcccagagguucugcugccacucagugacauuugugaaaugcaagggagcuugcaccauggguucaagcuccugcagaucccugagccugcuacccuugugcuucucuguccacgcaaagccaagugcuacugcgggguuuuccaaggcauagcuagcauccuaauagucucacacuugacauaguaggguuugacaugguuuaaauaaaaucucaaccagaucagugggagauguucuuugagauucggugauugaguugugaacguauggacugaggguguuuugugguaaggcuugagucaugucuguagcaaggauguuuccugaauaaugugcacugagcaucaagugccugcaguggccuggcggguaaugccagcagcacgggugaugaucauggucaacaugaccaacuagaaagcccaaaccccaccucuagcugacaguggcuucucagcuaaccugucaccacgugggauugggcccccagugguguaagcuuuuucagagaagcuacacaucuagcuuuuggaccugugaucuccccaauguuuuaaugcuggcaacuaauucaaauuaggaaggaaggaaggaagagagguuggaagggagagagagaaagaaggagcaaaggagaaaagaaaggagagaaggaggaagggagggaggaaggaaggaaagaaaaggaaggaagggaaagggaaggaaggaagggaagggaagaaaguaugggccacacaaaacaggucugugggcuugacuuguccucugaucaucaguuugugaccucuguucuaaagagugaaaacuauguaagauaguauaagauaaguagguauuuaaauuacuuugcaccuuuuccauuucauagaacuugaauguuuguguucaaagcuuaaaacccaagacagugagcuauuaagccuccauggccacgucauuuuucugauugcaucugauguaacaagugcuagaaaaacugaugcuguucauugcuuuaaaacgucuuucuuuauuuucuugguauuauuagguuuacauauucuuccgaacacacucuugccaucuccaugcaguuaagcuaguucaauuuaaacauugucauaaaguuaauuuuuuauaagaugaaucagguuauuaaauuuaguaaaccauugccuucauuauuuugcacaaacuuuggcacugugcagaauaggcuuagcacuacuacauuuagcuaauuaaacuggccgucagcugcaguauuacaagagugagggauguuauucucuuggguuuuauccaggacuuuaacaguagguagcauuauuaagcuuuuuuuauauaaaacuccacacucuagagauaugguuuacuauaaaaguguuauuguccuuccuguuaaacuaucaucuuuugaaauagccacgcuuuguuucuguuccaaaggcaauuguaaaggguaagaaaauggaguugucuauugcagcuuuuaaaaguagacuagcaacggguaaugcauugcuuagauaaaggaagauguaagaaccagaguguaauuucacaagacacagagacagauggcuuacccguaacuacagucaggaauucucuaaaggagagaggguggaagcuugagccuguagccuguugcugcugucuugucagaugugcccuuucugguaauaaaaaguccuuugccguggguuauuuugucaagugagauagcaggacuuaacagguuuguuugggaaaauaaaauuugauagaaaaacggcgugcuuuucccccacagauuucuugguagcaucauucaaaacuacagugagcaguaucuuugcaggauuuuaauauuuauucauuauuauaaaggaaggaagagggccaucguguugcaguuugaaacagccuggauuguuuuaaaauaguccagagcugcagccuauuagcagucugcaagaaccauuuguuucuucagcagauauuuauugaauccuacugggugcuagucuggcgaaauacggagauuggaggguguaaggcucaaggagcuuaccugagaaacuggauaaauaaagcucuguacugggugugguggcucacgccuguaaucccagcacuuugggaggucgaggugggugggucauuugagguuaggaguucgagagcagccuggccaacauggugaaaucccgucucuacuaaaaauacaaaaauuagcugggugugguggcacgcgccuguaaucccaguugcuggggagacugagacacgagaaucgcuugaaucccugcgguggagguucuagugagcagagguugcagauugcaccgcugcacuccagcccgggugacagagugagacucugucucagucagucaaucagucaaucaaucaaguucuggaaccugccuggccuuguguuauaucgaugcuuucucaaucuguuaaaaacguagcugcuauugaaugacuaagaauuguuuacucucauuuccacucucuuacaucuuuuuuuuuucuuuuaauacccugugaugaaacugugaagaaagauauuccugaucauugcuuugaccuggaaauuucaaagggacccacaguccaccauuccguccaagaucuucugggugugugaagucccgggcucccaaaugcaguuguguuuggucacuguguugcuugcauauggcuguuggcaucucauuagccugauugauggggcagaucagucagcaagacuuuguucggugccugcccccagccagcugggcuacaaaaccuggcauuuuacuucucucauuuuccccaaaugaucuaggugucuuuugcucacuggugauaaggggugacauugguaucacagguaaaaaugaguaaauuugagauuauugucgucuugcuuuaaagguuggagauacagcuucaaaaaccuuuuacuacccacacacccaaggggagucaaauggauuuagguguuaaauacuucagguuugaaauccuuugugcauuauuucagcaucugauuuaaguaucagaggucaucuuuagguaauaaguaaguauuuuggaauaugggauuuggcaaaaucucaagaaauaauuucagguugucucagcaaugagguuaaauugugcuccagaguccauauucagacaaacggaaugguggagcccgagguugauuucuuugaauucugguugguauuaaagucauucagcccucggguuaccauugguagcacaucuaggagcaaguuuuaauuuuuuagucauagugacugugcuggauuugguaggucguacgaauuggguaagaggcauaggacaccaaggauuuugcaaaaagcaggcaacuaacauuuguuuuccaccuacuaugauuauguuaggcucucaauauauguuuaccacuuauuccccauuuuacagaaacgauaacugaguuucacauggguucaaggcgugaccuuagaucccacagcuuguacgugcuuagaacuggcagcaacacaaguguguccaacuugaguuuuccucugugcuaugcugauuuuccuugagaaguauucuguauaaauagacuguuuucuaugaagauuaggccugugggagugauaugaaugaaugaacuuuacuaggcucuuucacauggugaugucaggaagauaacgguaugcugauuuugcgugcauauuaacauuaucuuguaaacaauaauuuauggccauuugacauggguuuggcugaauugcauagcugccuucucuaguagaauugacuacuuuguuauuguacuguacucuauagggucuuccaccacagauuacaaaauaugguauuuuuuaguuuagagcaauggguugguguucaagcucuggauuagacugccucuucuuuuuccucccucccuccccuccccuccucuccuuuccccuuuuuugagaugacuuuaaaauauagauucauauuuuuuaaauauacagaacuuuuucaguuuuccauuucuucuuguggcaacuuuuuuuguaguguuuuucuaggaauuugucuuuuuuaccuguauuguaaauucauugguauaaaguuguucaccauaucuuaagaucuucuuuggguucauaggaucuguaguccuuuucuuuauuuuucauuuuuaaaaacaacuuuauugagguaugauugauguacaaaaagccuuacguauuugauguauagaacuugauaaguuuggagauaaguauauaccugugaaaccauuauauuuuauaaguacaugauacaauaugagcacaguacuauaugguagaucucuagggcuuuuccaucuggcguaccugaaacuucauacccuuuggcuaauaccuccuuguuucucucuccccucagcccuuugccuacaccauucuauuuuuugccucuaugaguuugagugucuuagauuccucauauaaauuguaucauguaguauuuguccuucugugucuggcuuauuucacuuagcauaauguccuucagguucauccauguuguugcaaauagcagaauuuccuucauuccuaaggcugaauaauauuccauuguguguguuuguguguguguguguuugugugugugucuuccacauuuccuuuauccauucauucaucaguagaaauuuaggcugcuuccaugucuuggcuaguaugaauaaugcugcagugaacaugagagggcagacauauuguugugauccugauuugaguuccuuuggauauguauccagaaguaggauugcuggaucauaauccagcaauuuuuaauucuuguuucguuuuuugaggaaccuccauacuguuuuucauaaugguugcaccaauuuacauuccacuaaggaauguaaguuucucacgcauaagggggcucuuguuuccacacccugaaccacacuuguuaucuuucauuuuaugaugagaaccaccuuaagaggugugaggugacaucucacugugguuucaauuugcauuuuccugagaauuagugacagugagccccuuuucauacacuuggcuauuuguauguuuucuuuggagaauugucuauuugguuccuuugcuuguuuuuaaaaucugugguuuuuuuuuuuuuuuuuuuuuuugcuauuggguuuuaggaguuccuuauauauuuuggauaugaacacuaucaguuaugagguuugcaaguauuuuuuacuauuuuguagcuugcccuuucagugucuugauuguuuucuuuaacgugcagaagcuuuuuaguuuuacguaaccucacuugucuaguuuugcuuuuguugcuuaugcuuuuauguggcauaauguuguccuuuuauucaucccugauauugguuguucaagcccucucuuucugucucugucucucucucugucauucuugcuagcccuuuaucaauuuuauuaguuuuuucaauugacagacuuuuagcuucuuuuuuucucuguauuuuauguuuguuuuagauuuauaaguuucuccuuucuccuuuuauuuccaucguucugcuuucuuuaggcuuaauuugcuggguuauuuuccuaauguaauggaugcuuagaucaucuuggaugcuuagaucaucauuuuuucuuucuuucuuuuuuuuuggagcaagaucucacucugucacccaggcuggagugaaguggcaugaucauccuccugaguagcugggaccacaggugugcaccaccacgcccaacuaauuuuuuguagagauggaauuuugccauguugcccaggcuggucucgaacucuugggcucaagcgauccacccgccucggccaccccgauuccugggauuacagccaugagccacugugccuggucuucuuuuuaauauauguaguuaaggcuauagauuuucuuuuaaccauggcuuuagcuauacuccuuaaguuuguauauguguuuguaauuaccgaguuuaaaauauuucuaacuuucauuguaauuuuuugagccauaaugucuuauuuauuuauacauauauuuccagaaaugagaauuuucugggaucuuguuauugauuuguaauuuaauuccauugcggucaaagagcauacuuucuaauuuuaaucuuuugaaauucauugagacuugcuuuugccccugcaaaucaucaguuuugguaaguauucuugaaguacuugaguauauuuugcuguugcuuucaguguuuaucauauucaauuauuuucaguuuaucaauuaaguuguucaagucuucuauauacuuuguguuugucugcuuauuuuaucuguuacuaagagggauauguuaaaaucuuccauuauaauugugaauuugucuauuuauuguccuaauucugucaauuuuugacauauaugagaggcucuauuauuaaguacauauaaauuuagaauugucauguauucuugguggauugaaauuuaccauugugaaauauucagcacuuucucuuguaaugcuucuugcuuuagagucuuuuuuuucugaaauuaguacagcuauaucagauuucuuuuggcccguguuauacaguauaccuuuucuauucuuuuacuuuuuuuaugcuuauguuuaaauaagguauaaaacauaauguacauucuuuuuuaaggacaguauauguauauuuauguuuucuucagucugacaaacuuuuucuuuuaauugccaucuuuaggccauuuauauuuaauguaaugacagauauauuugaguuuggguuuaaauauaccaccuuauuauuggcuuccuguuaaguuauucuauauuccucuuucccuuauuucuauccuuucuuucucuuuuuucuuuuccuuuuuccuuucucucucucucucucuuucuuucucuuuccuuucuuucuuccauuuaaauugagacagggccuugcucugucacucuggcuggagugcaguggcauaaucauagcugacugugcccuugaacucuuggacucaggcaaucccucgacaucagccuucugaguagcugggacuaccgguaccugccaccacaccuggcuauuucuuuuuuaauuuuaauuuuuguagagacagaguuuugcuauguugcccaagcuggucacaagugauccucaugcuuuggccgcccacggugcuagaauuacaggccacuguaccuagucaucuucucuccuuucuugccuuuuuaucauucugcuuuucuucuccauuagcuuuuuaaauuuguagagauuuacaucuugcaucuuugacuuauuaaaaucuaauauaaaucaguauuauaucacuuccuggagaagacaagaaccuuaggauacuuugcuuccauuacucaccuccuagguuaagcauuguuauuauuauugauauaguaauuuuugcuauauauuuuaaaacucacagauuucacucuuaccauuuggaucuuaacaugucguuacccuuuauguugcucuuuguuacuuucugcaucucuggguuuauagcuaaggucauuuuccuccugccugaagagcauccuuuaguguuuccucuagugugggucuauacgugacacuagguguaguguaggugacaaacaaaaagcagcuuucguuugcuuaaaauuuuuguucucugccuuuauuuuucaaaaauauuuucacuagguauagaauucuaagaugaaaguuuuauuuuuuuucagcuguggcuuccaucauuuuccugagagguauaacuaucagucuuguagcuacuggucucuaacuacuucuaaaacuaucugcaguuuuuagcaguuuuacucugaugugccuugcuuugacauguauguguauauauguguaucuacacacacauacacacauacagauacacacucacauauauauuucuguuugcggcucacacagacauaaauauauauauauauacaaacguacauuucugcuuguagcuugcacauauauauauacacacacacacauacauguagacacacacauuuauacauauacaugucaacacauacacauacauauuucugcuuauggcucaggauacuucuuuuuuuggccguguaugcgucauugauuuuguaacauuaucagccauucugucuuuaaauauugcuuuucuuagucuauuucacuuguuuuggaacucagauuacauguauguguaagagccugggagaauguguuucauaugucucuuuugugcuuuguuuuauuguguuauuuuuuucuuuuuaugcuucacuuuggauuuuuuuguuaacuuauuuuguaguuuccucaaucuugucgucagcugugucuuguauucuguuaaacuauaugcugaauucuucuuuacucuuauuacucuuauuuuguuuaaguuucagaauaucuauuugaauuuuuuuauuguuucuaauucccuggcaaaauucuccaucuugccuuuuuguuccuugaauuugucagucagacuuauuuuaaucacuguuucugaauaacuugauuagacagaucuccugugcauuuauuuccauuuguuccccucuggcuuuuggugaaguuuuuucuuuuuguaugcuuagcuauuuuguuugaaugucugagaguuuauaugaguauuugaaauaaucauagugguaauuugagacucuagauaaugguaucuuccuccagagaacauuuucucuugcuucuggaaauuggauagauagggacugaucacuuuaaucaaacuaggaauugaaauggccugaagcugaguuuccacucuugugaaggcuggacugucucuuguuauuacagcgaggguauaacucuuuaggaucccgacccaagguuugguguguuuaccguggcccuuuccugguggguccugagcucaaauuuaugucuuuuuccuuguuauaaaauugccaaaagcucagcccaucuucucaggcuuccaaccacuauguuuggaaaugaaauaugccuugaaggaaaaaagcugccaaaugcuggccuugcaguuuuugcagaucuuggcccccaaaauucuuagucauagugcccuucugaugccuucaaacagauauggguguguaugcacguguguuauuuuguccaucuuuucuaauuguucucaguaggaaauggggcuaagaaaccuagguaacacugguagaagcagaggugcuggcgacacuuaccauagaguagagcauaaaguccuuaucgugggcacaggaucuggucauuauugaugguuaaauggcuggacaugccgugaacucuucuaugucccagucuucaucuuugaaaucacugcaucccuaggacaaguuuucucaccaucacaguguugacaguccgggccagaugguucuauguugucaggggcugcccuguucaugguaagauguuuuguaaugccugguguuuacccacuagaugccaguaggacucuaccccacaacuguggccacugaaaaugucuccagacauuugcuucuguccccuggggaucaaaaucaccccugguugagaacuugggguaauuuaaguggugcuccgguaaaggccauucaacaugacucacuguguugauguuauguuuucuaacauugacuuuccuuuaaaccauaggguucgaaaccgccaagucuuuugcccuccauggugcacaugugaucuuggccugcaggaacauggcaagggcgagugaagcagugucacgcauuuuagaagaauggguaagugcuugacuguuguuguuuuuuuuaauugucaaauacacaugccgggcuaaccauauggagauuucaguggaguguguaaaguuuauugcucuuggaaucaugucuuuauuuuuaaagucaucuucacuuuguuugucuuaugaaugaaagcaugagcaaguccauuauuauucacgcauuuguuuguaguucauugucagugucaucugcuuuauuagucagggguuugagaauguuucuuccuuuaacucauuuauuaagaaaaauaaaacguggugaacgcccaugauugcaacuaggagacuguuaugcuuaugguuguuaagauuagaaagaaggaggcuuuaacccuaucucuaauuucuuacuuuucucugucuauguagaaguugauguugauacgugucuacauaaauauuuacuaagggcuugccuuagucuugggaccaaggauauaguauuaaacgaaacagaaucccugcccucauaggcuuaccuucuagguaggaaaaauagaccauaaucaaguuuaauauuugccauaaugucaguaaauaaaggacuguaaagcagaggaagguggggggaaugauagcgugagugugauggagucaucagcagggagccuuccaaaguugugacauuugaucugagaccugaaugaaguagggguaagccaugcagaugucaagagaaguauucucuuagcagugagaagagcauaugcuaaggcucagagguaggcacaagccuggagauuucaaggaucaucagggaagcuaguguggcuggagaugaauggaguggguaggagaggugcuguugggggauggguaucugguagacucugagauagcggugaggaagacauuagaggguuugagcuagagagugaugcgagcuguuugauuuuugaaacaucgcuggauuucagaaugaaguccagacugcauucauucacuuuucauucauucacauauucaugaagugcaccucugugaugggugcuggggucuacuguuaaggacaacagacguugccacugucuuuguagagcuuucagccuauuguggaagacaaauuuagucaaaaaacacagaucuuaauguaaacuugaaaaagcagugagugguccuaggaaucaguaaugaugccagggaguugggagaccuuugggguccccaaggaagaagugauugaacuaagaucugaagaaagaccugaagaggguggagaagggucagaugggguaggggaauggcaggugcagaggcccugggaggagggggaggaggagauagagcagcguguuugggagcagagccugaagggggcuggguacacccuguggaggccgucuucauuuuugaaugcugugaaagauuucuugccauuugaagaaauagacuacaguguacuuaagaaaauuuuugguacucuggacugaaaaguagugaaaauaaagaaaaggaagauuuauuucugcuuuuucaguguauuuaugaugaaauauuugaaauucaguauauuugaaaugagcccuuaucuugagcucacugagcuuauuauuuuggguuaaauaaaaaagaaaacagagucuuacuuuuucugaucauuuuauugucuuucugacuaauguuaaaaaguaguaaccucuaguaggugggauaguagcaauuuuuagggauguauugagaagaguacaaaugggaauacgugcaucuuauuugaaucuacacgcagaaugggaaggugaaaaaugaaaugugaaagucguucuugguccuucucuuggaagauaaacauuauguauucuuccagaaaaagguuaucuauauaccagcaaacacacucacauucuguucuguacuuuuuuuuuuuuuaaacuuaguacugcaggagaucucuuauuagugcauauagaucuacuucauuguuuuaacugcuguauaauauuccaucaugugcuuaugcuauaaccagucuucccuuugguggccauuuagguuguuugcauuguuuugcuauuuguuauuccaagcaaugguguuucacaguucucucuuucuugcaucagucuuucuuacgauaucaucugauauugggccuaaacuaugcugcugugagcauucuuuauuuacguauuugugaguaaaugccuggggcagaaucuuagcacuggacuccuugauucaaagggcauaugcauuuaaaauuuugguaacaguucccgagucauuuucuuuuuucuuuuuuuucuuuuucuuuuuuauuuuuuuuuugagacugaguuucacucugucaccaggcuggagugcaguggcacaaucucgacucacugcaacuuucaccuccugcguucaagcaauucuucugccucagccucccgaguagccgggacuacaggcacgcgucaccaugcccagcuaauuuuuguauuuuuaauacagacggaguuucaccauguuggccgggauagucucgaccuccugaucucaugaucuacacaccuaggccucccaaagugcugggauuacaggcaugagccaccgugcccgaccucccgagucauuucuuaucuuguugcuccaauuuccauucccacugacaguguagacagacaacugcugagggcuugcaguguucuugggacuagcaggagggcgugucaaaauuguaaaacucugccuauuugauguaauauuugaaacuagaaagguaaaauuccagggacgcuagugacacuaugguaaccugauuguacagugacauucauguuuaaaccagucuuggaagauaaugcuguagcacaacuguuuuugcaucauuaaauuuauccucuucuuuucugagaacacaauauauaugagaacacauucaucugcauuuauccuauuuuaauuauuguuugaugcuuagagcagaaauuccuggaccugccccaauuagcgaugagaccuuggguaagccucuggaucuauuuggagccuguuuccucaucuuuaaggaaaaagguuggauggaugaugucaaagacccacuguucagucuuucuuucuuauauuuugagccuuaauugggucccugugagucaauuuccgaugauagaauuugcuguuuuauaguuuuacucuaacauguaguaccuugagauagaccagugaucccagacuaagaauuauucagaaucauucaccgucggggacacagaaaaaggaaaauggaacagaaacaaaacuaauacacguggcuccagauguuuaaaauuagauuugauagguuguaggcugaagaaacucaaccuguucaucaucucucaucuuuucacuuguucucucuguaugccauuauauuguguuccucauuuucccaagaugaugauuauggaaacucaaauuuugcaccagaagcuguaguuaccauuucauuccauugcaccauucauacccugcagagaggaugugaagucguaaggccuucuugcucuggugacaucuguuaggcuucgucucuauaucaucccccaacuccuugacccuugauauuugcuggucuacuucccuucagguccuuccucaccucacaucucugcgcaaggauuucaucugguaugucacuaaauauuaccuuccuguguuucucaaggucaauuugauagacuccaauuuuucaagcugcuggccagcuugagcguauucauauguuaccuacgaugaaucacaucagugucggggccgggaagguacugcaacauauuggcgccucacgggaggcucucaaaaugauccaaaguuuuuuguugcagcaaaagcucauucagaagucuuugggccauuuggcucagcggaggcugucaugugccaaggcuccgugggcauucuuagcucugcuucuggagauaagaguucauuccuccaucccaacuuguucuucccugcccauucuuccucuuccugccuucacugcacauuccgggaucgccauguucuagaacauucaugucugccuuuuagccagcagaaugcuauucucacauccacaaugggacagcuaacagcccccauuuaucaaaucccugucauaugcugugucaggcacuuuauaucccucauccaggaggaugcaaaaaccugguguuuuucuuuuuuuuuuuuuugcauuuuccagacgagccaagggauggcucagaagggugaaggaacucacccgaauugcacagcuggugagcucagagucaggcuccuugcuugguccaucuggcuuccaaacuccaagucugucugcuccaccccauggcccaucuuuuuaccauguuuaguaucaauguucauacuuugcagauuuugcuuucaaacucucuagcugcgguuugagugauuaauuucaggauccauccuauuucuuagaggaagccacucugaucuacccugucgucucuuuauauucaagauauccuuuauagagcucucaaauuacuuuugggaagaaggagcuauuuaauaaaauacaacuuaagugaaaacacauuccauauagaaguauauuaagaaccuauauguaauuacuaugacuacuaauuauuucaugggaaaaugcccuccugcugagauguuuuagaugcuccaaaguuagaagagaaaaaaugaaaacaauuaaaacaggauaacauggacaguacagaaguaaaccacugucuuaaaaggccaauccauuuggcauaauuaaaaaaagagggaggagauggaggcacaucagcccccauucauauuuaaauaaagaaaacggggcaguggggcuuguuccuauguuguggaacagcacacagaugugaucuaccucauucacauccuuaugugaauuauacacuggugcccucaccucuuaagacaagcaccuaucguuuuccuguguauuccaagaggccaguguggcugguggaauaagauguuuuccuguuuucaagaugcaguggacucucuuuuauuuaacagcagugucuauguguuaggaauccaugugaguucucuaagucugggacaacgauaggugugucugaguccugcauuaccaugguuuauucuuuccuuuacccaguaucuauuggaguugggcuucuguugcuuuauuucucggggucuggcauaucccacucccugucuugagaucucaggaccucugagaucucaggaccucugcauguaaagaacaagagcuuauuagguaucaaaacauacuucaugaacagcuacagcaagaccucgacauuccaguguagagcucuugaaagaccccaguggggcucugaguuccuccuucuucuguuucuauuagauuucuaaauuuuaguuucuaaauuuuagauccccggaacuugggaucuaaaacucugguccuguggaagaaggagguaggguagagugggagcagauggaccugaugucauccaucucccuacguuguuugcaggaggaaaagggaugaggcugaggcugggaggcaggggcgguggauugagagagaggagagggauuguuaugaguaaccaauguuccucaugccugccaggcccucacuagaucuguuuaacagagagugcagaagagcuucuguuggggacuggccauuaguauagcgaggggcccaauaaguguugugaaacaucagcaucugcuggacauugagauggccacagguuggucagagagggcugguaugggaagaggggcagguggcucucccuuagaguuacuauuugacucaccccugacuucccagaaugugucuugagucuauuacccucucauaugggaggggugacccaaguauguuuguggcaaccaaaaugucuccaggcauugccagaugucucuugggggugcaaaucguccccaguucauaaccacggcuauaaaacaugcuguauuauaguggcaaagauuagaaucagauacaucuuaugaccuugggcaaguuucuuaacuucuuuaaaccucaguuucuucaucuguaaaaugcacaucauaauaucucuauucagagauacaggugguucuauuaaacacaucaacucuguguauauaaagucuuaacccauuguggaauaaauuaagugcucaauuaaauguuagcugcugcuauuaauaacaacaauaauaauauuuucuucacgcaugaaagugcaaagugaugcuuacuuuucuuaaccucuccaacuggcugaaagaggagcucuagggcagauguuuaucagccugauuucaguggaguugcaaugaauucuuuuucugucuucauaugucuggacuccuacauuuuaauggauguguauuuaguuuguugauuaguauuuuccaguguagcucauauuagcacucaacugucauuugaaaagccaucuuaacuauuuaugugauugcuuuuucuuuuguauuuacaaagaaauacacucugcauauauuuuggaaagaugauuaagggauuagucaucaggaacagcaagcaaugguuuauaucaaaaugauuauugagaaagcagagagaugagggguaaaaauaaaagauuuauuagccagagguaauggaaugugcauguuuuagggagagagcgcaugcucaguugauugcaaccacacgguuugcugcugaagugcuguaaugauucagguuuucaauagaguugauaucgggucuauuuauuuugugggagugaagggauagggauaguacugacagcauuaugugauugcagccucauugauuagcaucggaaauaaugacuuuaacauuauuuucagauagggagcacucaguaccaaccauuauauuaggcucaugggcucaacauuuugcugugcuuuucauagauacugacaccuguguuuucauuuuguuguuguuguuguuuucccugccgggaaacugccgcauccuguguuuucauggcaugauauuaaggaacgauggguaggaugcugaggaguaaauugcucgcacuuuuaaagacuucugcaaaacuccaccuacuuuuaggcuccuuaaaauucagugacuuuaugagcugguauagcuucacuguuugugggaauuccaugcaaucuccuuugacacuaaaagcuuaagucccaugauuugccuuuguggauggaaggccuuggccuucuuuuaugauauauguguuggggggaggcaugugguauguggggcggguaaaauacgagccucaugccugucuaagcuggugacuuggcuuggaaaagaugaucauucgucaacgcaucacaagucacagggcuuaucuccauuguucugaacgaucuguagcuaaacaaaaagauaaaagcuauuaauauuauuaauaguuguagauuaccgggaagagcgcauccuaaaucagccauuagauuuguuccucauuucuuugcuuuacaaauuguuuuucuguauaguauuggauuuucaauaaauaaaggaugauauaaacaagucugcaaaccagcaagaacuauauaagccacuugcucaagucaauaagcgcaugcucacaaaggaacguaaaguucugaaguucuucuuuggggcguuugcaaaauguccuauuauugucaccugcaggugggggguuggauauuccuauuugucuuuguacuagguacugugcuuagcauuuaacaguaaaguauuuauauuaugugugaaacccauugugcagaugaggcaguuuagaggcuggaagaggcauagacuuucccaggcucacacagcugggagauaacgggguggauccaagauuugcagcuggugugugggugaugccggaagauuggccuuuuucaaggacuuagacaaguauuguacucauacauuauuugcauuuauuuguaugaauacuucuggguuccuaauaugaggguaccuaaaaaguacauccgcugcgcuucuuguaaucugagggaguugaugaacaugggccaaggaagcucuuuccuucgccuuccguuccagacuuccuuuucgaguaguauaucguguauuuacuguucuacuucaguugccuauuugaccuuucuugucacaggcucagggaagauucuuuaucagauaauaaauuauucaucccccucauagacauaaucgguugcuaaaauauucugaguuuccugucuccagaauaccuaaaacuugugcuugguacuuauccucuaaguuuuccguuucauuucucauucugaaaauuuugcaccgacuuagucuugaauguuauucauuguucuuugaucauugucuuugugucuucuccuuuuuuuuuuuuuuccuggccaccgcucgcagucuugaaccgaaucuuucaaacuuuauauccauguaaccuuuguauaaugagggcugugauuaacugcagaguuuuaaagagugaaagucaagcauagguggcuggcucugaaccaucacucccaauaaugugaaacccaaagcagaugcauccuuucauuaaugugggguccccugaguucuuauuaagcaauuuugacauaguuugaagagacggauuucauguucagacaguguucagccgccaauggcugaaaggccugcuuuuggccacuuggcauuuagacuccauuauuuaagaggggaaaaauaugccugagacuguuuuucauauuuauugugggacauuuagagaaucucagacuagcagguguuagauuaaacagaggagaaacgguccuuguggugauaaaacuucccuacgcaaggacaaguagagaaacaacuguagaugaagcagccagucucaggcuggggcagcacgcccugcgauagguuaagguuuauuuuagacaaauauuuaaaaugcagcuaauuuuuacauaugcagacgcaacccaguggaauagagguagccccagcuuuggagucauacagaucugggguuaaaucccagugugaauacuaacucacucggugucccugggcaaaucuggucaucucucucucucuuuucuuuuuuugagauaggguauugcucugucacccaggcugguguucaguggcacaaugaugguucacugcaaccuugaccuccugggcucaagugauccucccaucucugccuccugaguagcugggacuacaggcuuaugccaccacaccuggcuaauuuuuuuuuuuuuuuuuuuuaauguagaggaagggcuucaccacguugcccaggcuagucucgaauuccucugcucaggcgauccuccugccugggucucccaaagugcugggauuacaggcaugggccaucgugccuggccuuagucaucucuuugaaccuuggcugauuuaccugcagaugcuaauaugacucucagauucuggcacauaguaaagauucaguaaauggucguugcagggaaagcuaacuuguccaaugcagaucuguaaaauauacucauaaaucuuguuggagcaauauuucuucuuugucuuacuucgggcuaauaacaaaaauaucauacaaugaguggcuuaaauauuuauucuuacaguucuagaggcuggaaguccgagacgagggugccaaccuuguugaguucuuagugaggucccucuuucugguuuuuaaguagccuguuucuugcuguguccucauaugguggagagcugagaggaauugagagagagagagagagaggucgcacugucucaugugucuuguaagggcacuaaucccuucaugaggauuccacucucaucuaaucaccucugaaaggcccugucuccaacuaccaucacaugggcaauuaggguuucaccauaauaauuuuggagggacacuguauuaguccauuuucaugcuucuaauaaagacacacccacgacugggaagaaaaagagguuuaacuggacuuacaguuccacauggcuggggaggcuucagaaucaugguaggaggcgaaaggcacuucuuauauggugucagcaagagaaaaaugaggaagaagcaaaagcagaaacugccugauaaacccaucagaucucuugagacuuauucacuaucaugagaauagcaugggaaagaccggcccccaugauucaauuaccuccccccgggucccucccacaacaugugggaauccugggagauauaauucaaguugagauuucgguggggcgcagccaaaccauaucagacacaaacauucaauucacagcauucuaccccagcccuccaaaauucauguucuucugacaugcuaaauacauuuauuacauccaaauauccccaaaaucuuaacucauuccggcaucagcuguaaagucuaugucuuuuuaauuuuuuuaaaugaucaaagcacugggaaguagccacuucuuuccucagcuucccaccaaugugucaauuaauaaucugacuaagguggccgggugugguggcucacaccuguaaucccagcacuuugggaggccaaggcgggcggauugccugagcucaaaagcuggcgaccagccugggcaauacggugaaaccccgucucuacugaaaauacaaaaauuagcuggguguggcggcaugcgccuuuagucccagcuacuggggaggcugaggcaggagaauugcuuuaaccugggagguggagguugcagugagccgagaucaggccacugcacuccaaucugggugacagagcaagacucugucucaaaaauaauaguaauaauaauaauaauaauaauaauaauaauaagaaucugacuaagguuauuaaccauuaagguaugcugugcuaaggagcagggggccccuuccauccguagagggcagaaaggugccuaucaugucuucagugucagugcccugguauggagcuagcuggccuuccacagguucuggaguuaaugcuggagagaaguaggggugucagagccuacccuguguuccuagggggguucaucuggagcuagucccugacccuuagguggaagaugcagcuaugcccaagguucugaagacccuguaaaaggaagccuuagaaguggcugcgauuguuuuaaagucuguccacaaauucuuugauaauucuccuuucaagaaguagaggccaguucuccucucuuggaauaugggcuguacuuagugacucacucuccaugaauagaauuuggcagaaauggccggguaugacuccugagguagguccuaaaggcuucguggcuucuucuugcucacucucuuggaucacucaccagccaccauguugugaggaaacucaagcagaccugaggugaggcccaugcaacaaggaauugaggccaccagccauguauaugaucccccuuggaauccuccagcccagucaagccuucagaugacugaggcccuggcugauucaugucaugagagauccugagucagaaccacccagcagcuaagccacuucugaauccuugacccacaaaauaugguaagauaccaaaugguuacuguuuuaagccacuaugcucugggggaauuugugauguagcgguagauaacuaucacaggauccauggccucaaggggagaaggauccuuaagagagacuggacagugaguucuaaggauaagacauguauacuuacccaggaagcuccacugugugcaaggaauccuaaguucccgggguugcauccaucucccaggucaccuuguuugaccucucuccaacacuuuuaaaacauaccugaucaggaaucaccccgcuuuggcauaaguuccucucuccccaugcugcccaucccauuucugcacaccucuuaauuaguaaguucucccucauauugaaggcagaaucuuccucugagcgucuucuaugcaccggcccugguccugcccuccgaguuccacuggcugcauucucaucagaacccagcuaaaacucacgucucucaaauucccuaaauaauaaauccaaaguuauugaagauauugggauacuaaaaguuggcagugagacuggccccacucauuucuuuguaaccccugucccucuuuuuauuauugaagcuugggaugcacuugguaaggcuaggcagcuggagagcgugcagacucaggagccaagaccugccuugccuucccuggaguuaaugaaucagugugaaugaagagcacagucuucuuuuaaauggcaggggaaccaugcacuuauuuaccggcaauucucagauucuaauuguuccgacuacaaugcguccuguaaaccggguagcugggagaaacuucaaugcaucuuuguaauggcuuuguuguuguuuauugagagggacuaauuaacuuugauuauugcacuaauauuauggcacuuugacagcccuucagauuuaugacucugggaaaauaaacaaaugaaaugcaggugcuggagcagaaagaauaaguuauuacugaacuuuaauuacuuggaaugcguagccaggagagaauuaguugaugaauuacaggaugcuuaaaaucuacaucaaauugcaagcaauaagaagauaaaaauaaaaaggaaggggcaggaagggugcuauuuuuaaggcagggaaggauaggaugcauuugcaguggucuccgugguguuucauugauuaaacuuuguggucucuaaugcugcagauauguacauggugcuacucaaagcauggucccugaccugcagcaucagugucacuugagagcuuguuggaaaugcaaauucuugggccccaccccagaccuacuagguaagaaucucuggagguagggcccagccaucugugguuugcaguuacuccaggagauuuugauaucugcagaaguugagaagcauggcucaacaguucucaugcagcuugcuuuuucuuuuauaaaagggcggguacacauuuuuaucuuugcuuaugaaaaucaaauguuuucccaacccaguuuaccaaguagcucccaaauuuucaagcuauuuuaaaaauuggcugaaauuuaaaaauuuugggcaauuuuaauuuauccaacaucuauuacgugcuaggugguagagugggugacacaagauagucuagaaggauuuugcuaaugaggugauaccccuaaacugucaucgaugccagcgccuggguagugugguaagagugauacucccaugacucaugaaagauggucuccccacgugcuuuaaagcaggaugguugcaggagaaaguauugguggacugugaacagcccccauggcaagggugcaucuggagcuggaggaagagcauccacagaguguaaguaguuuguccugggaauggagaugucaggcuuggguguggugucggggagagggcaggcagcuccucuaugaggccagaucauucggggccuuggauuccagucuuaggagaauagacuuuauucucuagguccuggcagccaucacuggcugagucugagugguggugauacaguccauacucagugacugagauagacagacauuugggcugaauuagcgaggggagugcggggucuggagacucuguuggccuguuggccaugguccugggcgcaaagagcagaaaaggacgagacggggacugaacagacuugcuuaguuccugacauucaaggaagaacuuuaacguccauccacggagccucaaaggcuaaaaauaaucaucccuuucaauaguuccuguugugaggaccauuaacaaauuauaagagaaagcauuccucacuuguagaaacuccaugaaaacagacauguguuuacuuaucugcaacccuguguuaggaggagggugaugagacacuuuacuguuugaaucaggaagugcugacagugaagggaggagcucuucauaauuauacccggagagcaggcaagacagccacaugcaaguggccuggccuggcuggguuugguacagaggggauuagggcagauucaaaccucacuggucccccgucccagcacuucugugcugucugcaguuacuaagcacuuuuccuguuuaaguuguugcuguuuucauucccgcaaaagcucagccagccucuagcccaaaauugucucuguuuauuggacaguuggaaaugucacuguggccccacagaccuuguugucaagcaggcugcuacgcuuuuauucuagagcgucuuucaucugauuuccuccaccaucuggaaccuucuggauucuuccucuuauggguagugaugggcacuuuaggaguaggaauacaugucagugcuagaccacauccuuucauacccggaauucgcauagugacauuuaaaaauagauagcaggccaggugcgguggcucacgccuguaaucccagcacuuugggaggccgaggcggguggaucacuugagguuaggaguucgagaccagccuggcaaacauggugaaacugugucuacuaaaaauacaaaaauuagccaguugucuuggcgcauggcuauaaucccagcugcucaggaagcugaggcaggagaaucccuugaaccugggaggcagagguugcagugagccaagguggugccacugcauuccagccugggcgacagagcgagauuccgucucaaaaaaaaaaaaaaaguaaucauuuuagaauugcuuucucuucgggaugguuuaccucguguuuagucuguaaacgcggauaaccgagagcuggucaaauguuuacauggggcuguggaccauuuuguaucauuggaggagaagccagggcacuuggcagggguguucaugaugauaaucagguggcuggguggagucaccauuuguggcauccucaaagacuugccaacauagacauuuuuggggagacagaaacacagaaauaauucugcagugcuuuaaagaaucuguuaaaaaucaaguuucuuucagucauguaugauccauugggcuuuauauaacuuuuagccuuugcuuugcagggacagcaaagaugugagcaaauuugugcaaaccuaauagggugaaaaauugagguaugaauuaguaaagucauuuguccuucuggaaagaguuauggauuaacagauuacauuuggguauauugugguugugaaaagguaacauucucagauuggaaaggacuuucugagaucauccaacuuaacuuuccccacuugacagacaagaaaacugaggcccacagaagguaacuuaggcaauuaauuaauuauaguuaauaauuaauucugccugcagaacaggaauauggcccccaacgcuucaugcuuaauuggauggcuuauuaaauucuuauuuuuaugguagugaugaugaugauaauaauaauaauaacaguaguagcuagcauuguuuuccagugcuaagcacuuuaaaugcauuaauucaguucaucuuuaugacaacacuaugagauagcuaauauuaugaauccuauuuucagaugaaagacugagucuuagggaacaaacagccgagagaugaaaugccacagggaugucuagguucaaacagcaacagaggugcguaccauagggauguggaagccuugcuugucuuguuccucuugguauaaccccagugaguagcauagcgccuggucaauuggagggauuugguaaauauuuacugagugagugagaggguaaaacagcugagccaugggaguuauaacuugggcagcaguaauccugccauuguaggaggggacagaucggcugguuaguuuuuggaaagcagaccagcagaaguugcaaauaacuuguuguguuuuccuaaguacugagcugugugaauugguuucauguugauguuacugaagucuccccaauucaucaucuaccuuguagcuuguugaagaaagaguccuuauuuacagucuauuauguuaaacguauuuuauuccaguucuuugaaaaugacccauccugauuuggaaaaucucuaacuugccuggucauucuggagcagugggagccgacugugaugcagaguggacucauaauccagcuugauuuugagggacagaaaccugggccuuuagguagaaugaacagcuuaaaaggcugcaccugagaguagggggcauauggguaaauccagcuguacccaagaguugggggcauauguuagcccuacuggguaaauccagcugcacccaagaguaggggguauauguuagggcuagugcguaaacccagcugcacccgagauaugggguauacaugagugcuauugggcaaauccagcugcacaggagaguaaggggcauauguuagggcuaguggguaaacccagcugcaccugagaguagggguauauguuagggcuuguggguaaauccaguugcaccuggcaguuggggcauauguuagggcuaguggguaaacccagccgcaccggagaguuguggguauauguuagggccaguggguaaauccagcuccaucugagauaugggguauacaugaauacuaguggguaaauccagcuguacacgagaguagggggcauauguuagggcuagcagguaaacccagcugcaccccagagcagguguauacaugagugcuaguggguaaauccagcagacguccggacugugcuugagggugucaucgagagagagaagguugauccgaaguuaguaaaggcuuuaaaaauuaaaaggccugagaugaugguaggguuuuggagguaaguauaaaaaccuucuuguuuucuacuacuuaaagcugaaaacccagcuuggguuggcuuugcuucuaauauccuucuuccuuuuuguuucauaaguaauuguccugaagccugucgagauaaauguauacugaaagagaaagacacagaggagagacaggcauacagagaaagagagacacgcagacacacgaaggggagguggagacacggaggagggacagaaagacagagagagacagaaggagagagagagagagaaccugucuagcgguguuuuuaugagguuuuuagugcugggcuuugcaucguggugacgguguguguguggggguguugaucacuguuuucaguguucucugaucauuucuugcuuagaaaggaggaaauuagaauuguugagcuaugauuuguuuuaaucagaaagaaauugucuaacauaaaucucuucgugagcucuggaaaagccccuaaagcggccaggaaaaaaauaucaauacuuugcaaaggaggaaugauuguuccaauucguggcuuaauugacuuuaagccuuaaugaaacuaaggccggagcggguggcacacuccguggcugggauccacagugaaaucuacgcugggagaggaggaauuuagggugguaauuugguucuuugcuauugacgaaauuuucuaauugacugggguuacuuaauaccagauaauauuuuuuucuugcuauaaagagaguaaauuuguuuuuuucugaggaacacaggaauuuauuuuaaauuacagcuuuuucuauuggaagcauucauuuauguuggauuauuguucccugagugaaauuucacugaugcuguauaauuaaauauagauuuuuuuagagauaguauauauuuuagauguauaaguggauaaacuggagguauggaaggucuuuauuuaaggagaauaaauagcccaccccaucaacaugauggcccuuggaaaggacucuuuuagccuccgcgaguuccuuuuccgcaccaggcuccacuuacgaaggacugcaaaaacuugcuaacgucaucagucugaaaggauugagcuguaaaauguguuaugggggccuaagcaacgcaucuggaauuuagccuucccaaguucaaauccgguuuaugccacuugcgaaaaccaugugaccuucacuuguucuuauugccucaguuuccucaucuguaacuuggggaugaugacaguauuuggaucacaagauuguugugaagaugaacugaagugcuaaugugaaauguucaugaugguacccgaguacuugcggugguaccuagcgugugcuuuccaagugcuggcaaagaaaagaaaagaaaugcuuggggcucugccuaccugucuaggcuccugucuggccauucucuuucuuguuccaaccauaucaaacucacugcuguugcuaaaccuuccugucucucugcaucuuggcacagacuauguccucugcuuggaagggucucagcuaagcuuuuccuccccacaucugccucuguauccugugagucucuguucaaggguaucuuucccacaaagcuuuccugggcuucucuuuccugucuccugcccucccuuccuucuuuuguucagcacaucgcugucaaccuucuucucugggucagguagagcacugagcaccagugauauggcagugauaaagaaagcaaagguucucacugggugugguggcucacgccuguaaucccagcacuuugggaggccgagguggguggaucacgaggucaggagaucgagaccauccuggcuaacaaagugaaagcccgucucuacuaaaaauacaaaaauuagcagggcaugguggcggguaccuguagugccagcugcuugggaggcugaggcaggagaauggcaugaaccugggaggcagagcuugcagugagccgagauugcgccacugcacuucagccugggugacagagcgagaaucugucucaaaaaaaaaaaaaaaaagaaagaaagaaagcaaagguuuuuuccucccaagaacucaugguccaaguuuugguuuuuaaauaugcaucuaugacagcacggaucacauagugcauugauuguuugccuguaggucuccuuauuuagucaacaagcauguuuugauccuuuauucuauaccagccgucccacuggacucucagcacauauagguaugcgagacguuguccuugcccuaaguguggagacagacacguaaauuaauaguaauaauaauaucuaccacccacuaggggucuauguguguauguguugggggcgguguggcuggggagggaagcaaggccuguauuauggcccaagcucaagaauauucgggcaagagcagauacaaugccuguauuucucaucacuuuuggguggcauaggaccaguugguuaugagcgugaaagguuuucuuugacuuugguggucuaguuagugguugagaacauggauuuuggaaucagcccgguggagguuggaauccuggcugcgccguucuguagcaguguuguggaucucagacaagguguuccugcauaugccucucuaucuuccuacaagaaauggagguauugcauccccgaaccguaggaugcuugucaggauuaaaugagauaacagugccugguuaguggcacaugcucaguaacaccugccaaguaccacucacugagccgaaaucuccugaauaccaccccuucaugccuugcacauccuggguucuaacucauugaggugcccccaccuuuccuucuucccaucaacaacucuugugcccacgagggacuggccuccucagugccacacagagccuccccugaguagauuugugucauuuucaaacaaagcauccuggcugcaguguuggauuuuguaggauggugaccguuuacagaaaccucugguccgugagccaauuuggagaaaauugaaucauucucugugccuuucggcuugcauccuaaaagccugcacaaacacuuugggcaggcuucagcaacuucacaucaagggcucaauugcagcuccaauauaaaaaccucccccguugcucucugugugugaagcuggauuccaugcuuggcacagaccucggugcucacgguaaugcuuccuuccaccauaucagaagguccucagcagccgcagccacuuaacaugcucggugcuucucuguaggaggauuuuuaaaaagcaggaacugucagggucccaaauguucaguggcacuucagccagagguaggauagggauuuugaaguguuuggagaaguguuuucauauuugaauuuacggggauggggugggcugggguaggcaagggacagacuguagcgauucgcuugguguuuucucaugaugccagagaaaaugaccucauuaucaucaugcucacauucaccuuugccaggaccccuguguagaaauaaucaugaacuuagugacugacaaucauaagcguuuuaugauuuguggaggauuuauaugugaaggaaaauggaugaauuaaaaauauuaaacagcuuagccggcacccacauggaugaaucaccgagaucuauuuuuuccccguuuauacuauaaacauauggcaugaauuuucugcucucauuacagaugcugagagaaggcaaagacaaauauuuauauuacauucauguuuuacaguaaaaacacuguucgguuuguuuacacaguuccacuguuacaguuuuuauggucgguaaugcaaccaccguaaaagcaagucuggguuauauagcagaugugauaagcccucauacucagagagaugucugggaaagaaucguugaugucacauguacaggaucaacaauggaauuauguguugggacagucuaaguuaugcuguaauaacaaccaaccucaaaaucucuggggcuugaaacaacaaagguuuauuucuugcucaaacuguauuuucaucaugaguugcuuggagggaucugugagauggggaucucacucagccaccggggcccacagagcagccugcacugcuggauguugugacagaggaagagagggaugugcugacccucgcucuggcucaaaagugacuccugccaucucugcucacauuccauuggccaaagcaagucucagggccaaggagugggcaguaguagggugcuguguguguguacaaacccaccauaugugcauagagggaggccgagaacuggacuaucagagaauagccaaagauuucuuuccacggucaugucaagccuuuuugcuguuauuuaauugauguucuauuuuuaaugcaacauggaaucagaagaauauagaacaggcgucaaagacccucccgccucuguaaccgcacuguuuaaaauugaugagacucugucuucauucgaagaugaucugauaggaaggauucacagcuuuccccaagaauacaccacagugcauacaaauccucgaagccgcagaacuuuuucaaguugaacugugaacugugauuuuuuuuuuuuuuuaaguaaguuuacauguagaagcucauugguagagagcuuuagauauauuacuucccaggguggugcauccugucaccaugaaguaggcaugaaaugcuggagauaugcguucauucaaagaaaauaaaaaggcgcaauuaugaaaagcucucaaagugacuuuuuauuuuauuuuuuauuuuuacauggagucucgcucuguuacccaggcuagaguacaguggcgugaucucagcucacugcagucuccaucucccagguucaagugauucucccgucucagccuccagaguagcugggauuacaggcacccaccaucacgcccagcuaauuuuuguauuuuuaguagagauggguuucaccauguuggccaggcuggucuugaacucuugaccucaagugauccacccgccucggccuccgaaagcguugggauuacaggugugagucagagcacccggccucaaagugacuuuaacagcaacuuaaaggcgguggcuagcucugccccauucaguaugguagccacuggccauguguggcaguugagugcuugaaagguaguuaguccagauugaaaugagcuguugauauaaaauaacaugacucccagguuucagacaguauaaaaaaaucuuaauuaacauuuuuauauuaguuccaugcugaaauaauauuugagacauacuagguuaaauaaaauaucauugaaguucauuuaaucuguuucuuuuuaccuuuuuuuuuuuuugacacggcuccuggaaagguuaacaauauguaggugacccuuuauuuucaucagacauugccgaccuagaggguaaccacuggagaggaaaaaaguacaauuugguauuuuugucacaaauccuuaauugcuagaacucacaguuuaaccugacaguugaucaauugauauccuuugacuuguuggaauuuuauucuuuacauucgucuuuuaaaaagcuuuauuuuaugccagaugcagugccucaugccuguaaugucagcacuuugggaggcugaggcagguggaucacuuguggucaggaguuugagaccagccuggccaauauggcgaaacccugucucuacucaaaauacaaaaaguuagccgggcgugguggcacgugccuguaaucccagcuacugaggaggcugaggcaggagaauugcuugaacuugggaggcagagguugcagugagccaagaucgugccacugcacuccagccugggugacaaagugagacccugucucaaaagaaaaauaaauaaaaagcuuuguuuuaaaauaaguuuagauucucauagaaguugcgaagaauagucuauaguauucuucacaaggguucuggguacccuuaacccagcuuccccagugauagucacagcauaacaaucaagucugggaaauugacacuggcaugauaauauuaacuaacuacagauuuuauccgaguucugcuaguguuugcauguacucauuugugugcggcucucucuguguguguguaguucuaugaaaaguuauaacauauauacauuugguuuaccaacaucauagucaggauacagaacugucccaucuccccaaagaaacacccuuuaccuuaguuuuuauucuuugaguuauaucuuaaccagguuaacugaggguaauugucuuaggcaaguuaguaccaaaugaugcucuugguuccuugucugucuuuuugcccauccaacccacccuucacacauggccgaguuaugccaaacuuugcaagaggugccaggugggcacaaagaaaagaggacugcacucaaggaacuuagucuuugaggccaagcacgguggcucaugucuguaauccuagcacuuugggaggcugacacaggcagaucacuugaggucgggaguucuagaccaacauggugaaaaccagucucuacuaaaaauacaaaaaauuagcuggccgugguggugugcacccguagucccaccuacuugggaggcuaaggcaggagaauugcuugaaccgcggaggcagagauugcaaugagccgagaucgcgccacugcacuccagccugguccacacacagagugagacucugagacuucgagacucuguccccaaaaaaagacgcaaaggagcucagucuuugaaggguuacagaaacaguuucacuagaaggugugacauuguguaacagaaaucgguuccuuaaccugccaaagggaagaaaauagugcggaaucuuuucuccagguuucaggacccaugucuguuguccuuccuuuaccuuaacuucagcagggcaagaaugguucaagccacauuagaaagcaguuacuuucucacccaauuuuaaaggagaaagguagaugcgguggguucuagggauuucagugacguaacagguguuucccaggcauuaagaccuaguaagguuuccauuuccauuagguauuauggaugcauuccaagaauuuaauuacuauaacaucacuucauucauuguaauuccuuacuagaguuaugagaacuugggauugugugguuucuuauucaaucgauuaaaagguacuugcuauaguuuucuaacuagcuauuuauaugaaauuuaguacuugucaauauguauuaaaucaauacaguuauauuuaucaaaguggugagaagaguuuacaucugaacauagaauagauugcuugccuuggccgggcgcgggagcucacaccuguaaucccagcacuuugggaggccgaggcgggcagaucacgaggucaggagaucgagaccauccuggcuaacacggugaaaccccgucuuuacuaaaaauacaaaaaauuagccaaugugguggugggugccuguagucccagcuacucgggaggcugaggcaggacaauggcgugaacccaggaggcggagauugcagugagcugggauugugccacugcacuccagccugggugacagagcgagacucugucucaaaaaaaaaaaaaaaaaauaguagauuguuugccucaguugggaaaaaauaaaguuuuaaggcucuagaauuggagugacucagcuuuacuugaaaaaucccagaauaguaggaccaucauuuagaaguuucgagacgauaauauuagggaaaaauaacagcaaauguuacuugauagacacuaaacucuggggcauaugagaugacccaggcuggaaaaccacuggcuuacauaaagguauugacagacccauggguguuaagauccuucauggcuacuggggagaaaugacaggccuuuugaaaucguaucagugguuuucccugggaucacuggaaauaauaccccuguuugacaagauaugacacaugcucuguuuuaauucugcauuugacuaacagaaaagauuggugaagaucagacucugcuuuaaaguuauugaagcaggguacaaggaaaaggggaagggaauagaggcugcagaggagaaugggggaagggggcaggaagguaaaauuuggaggugcaggcagagucaaggucaugccugaggcccaaccuuccuguugaagcugguguuugauucaagcuguggcugagaacgugcagcucaucuggaggguagaguugcaagacauggguucaggucugagccaagccagaaacuggagaaagcguggcuucucaagacuaggaauaccuagauuccagagguggcgugggcauggggcacauugugacaaguuaacagcaagaucuucagagcugcagcucaccugugccacgauggucuccuaggagcccuuuccugcuguagucccgccccgagggguuucacuucccacugccucuugguagccgugggcacuuuggugcucugaugauguaacauggagauuguccuugucuccaucgcugucuuuacugguguaugcccaugagguaugucaaagucuguaugucuuuguaauaaugcuggaucauuuguccaccuucagagacaacugaagacaguuuuaagugaaaccacacagagggcauauaccauugggacaagaggucugaagucuauuuuugagaaagagaagagaucaaguaguuaacagccaguggcuaucauaauaauggcaccuaaacaaauccuucuuuuuuauuuuauuuaauuaauuaacuuauuuauuuuugaguuggagucuugcugugucucccaggcuggagugcaauggcgugaucuuggcucacugcaaccuccgccucccaaguucaagcgauucuccuggcucaaccuccuaaguagcugggauuacaggcaccugccaccacgcucagcuaauuuuuguauguuuaguagagacgagguuucaccauguuugucagguuagaccggaacuccugaccucaagugauccacccaccucggccucccaaagugcugggauuacaggaaugagccaccacgcccggcucaaauccuucuuacuuuuccucaagaacucacuucccacccaaaccuuuccuauuguggcagcuguuaucuuguccagcacauguguccacacuugguauuaauagcuccaucuuaggaacuaugaaagugagggggguggugguaauuugcaugaacugguuugggccaguuauggucuguuacauccuugcugaaaugguuggugcuaagaugagcacuuggcuuaggccagaccagucccuagccuguggagaaggggcaaucucuuaucugaaggccuaggaggugcagggauguuuauaugggcugcuagcgcuuaguuuccugccacagggagacaguaagaaaggugacgucaaucugagaugagagagagagcaaaacaguucuuuugaccaccuugaccccgaccuugaaauaagguggaacuaauaaaucccgcuuugugcuggagcaaguuuuggcugaguuucugucacuugcaaccaaaucaguccuauccaguauaccuagugacucucuggucuccaaaggcuaugccugcuggguacugagugucuccccgaccgaccccaugauggcuacagugcacaucccuuccagccaacucuauugugcacacauauucguagggugaguugggccccagguagagugauuggcucagauccugcauccuuucagggucugacuguaaucacacuggcauggcagggggaaaguguauuggauuucagagucaaaaaccacuugguaugaaacccagcucauuuucuauguggauguccaaccugagccagauaauuaaucuuggagaugacgcugcauacuucaucaaguuguaaaguugacugcugugauaauggagaaugcuggacaggcugcuuuucaugucauggguucgcuauacuuuaguucccauuauaucauccugccaauccccauuuguuguuuuuuugggacccaggguaucagucaucugaucauugugugacuuucucaaggaccuuuacuugagucuugcaccucugguccacaauguccacauaccagcuugauggugacuugugucauucuccauccccuuguuaagagaaaaucuacuuuaugagcccucuuuccaaccgcaguguugaggacuagaccaggcaagaugaugccgcuggaccacuggauccagcuggaccgcuagaccacagagccccuggagccucccaaggccaagcccgccagccacacacaccuuugugagaauuaagaaaagaugcccccuccucuuggggcccacagcuccuccaccugggcacccagccuggugaacagggugcaggcugggauuuagcccuaccuugcuuuuggaccauugagcuacuaaguuggagcaacaaggcuugggaauuuuucuuugaucauagguaggaaagguaaaaaaacauaaaucugccaauagaaaauagcaucguaaugaguuucuacuauauuuguuugggcuuugaaaaauaugccgccacaauauaucaauguauggucccaacguuuuaggaaguugcauuuaaaaaaucuuggauaccuguuuuguacauauuauauauagcaucccgugugaauauguuaauuccuuuuuaugaguuucggucuuuuuucccucuccuauacaugauugcuguuuuauagcuccaguuugguggaauuaacauagauuucccacauggggaagguuuugggugaggauuuagaacaaggcagguucuugauccucggaagagauucuuaucugagaggggauuugagaauggcauugcagagugggaggcgcugcuguguggaaaaaugaacuggaauaauuauuagaacaguucucagaauuuacaggauauuugaucauaggaguaacuuuccucaggagugauggauggaaugccuguacuuggaauauuuuuaaauuaaucuauuuucauuacauugaaaguaugacacacagagaacacuaaaauuggaugaggcacuaccuggaauuauauaaagaaugacaaagaugcgguuauccauuuauuuucuaggcaaguuaguuagccucucuguguuucuauuucuuuguuuauaaaagagggacaaaaauaggaccuauuacuaucuaggugacaggaucauucauaccccaaaccucagcauaaugcaauauacucauguaacaaaucugcauaaguacccccuuaaucugaaauaaaaguugaaauuauuaaaaaagaaaacgaaggccggguacgguggcucaugccuguaaucccagcacuuugggaugcugacgcggguggaucacaugaggucaggaauucgagaccagucuggccaacauggcaaaacuccgucucuacuaaaaauucaaaaauuaggcuugguggcacgugccuguagucccaagcuacucaggaggcugaggcaggagaaucacuugaacccaguaggcggagguugcagugagccgagaucgcaccacugcacuccagccuaggugacagagugagacuccgucucaaaaaaaaaaaaaaaaaaaagaaagaaaacaaaaacaaauaggacccauaucccuggauuguugaggaaauacgugaacauauguggcacacauuauagugucuggcauacaauaaauacuuuguaauguuacuggugucuucuuaccguuauugucucacuggugaccguuugaaauguugaagcuuuauuguuacagauaaugguggauauagucucuuccuuguuuauuuuuugacagaaucuuuuuuuaaaaaaguuuuuauuuguuuggugagaauuuacuuguuacaggucuagugcuguuauaguugaauguuuugaauuauguaacuuaagugaaacauaaagcuaugacuugaauuuugugguuagaaauuuucucagucgauugacaaggauggcguauuggccaccuuuugccgcaguaacaaacaaucccagacucucaaggcuugcaaaaauaaauguguguuuguuugcucauaacacauguggcugaggguuggccguggcuccacagucacgggugggcuuuccugggcucagcuucucacagcgucuccuugcagggcccaggcuguaggagaugucaucagggccugcagagggcaaaaccucacagaggcuucuguucauacauuguuguaccucaugugugcgucauauugucauauaucaauggcaguagccaagaccaacagccaagaccaauguauucugcccacaggaaagugaggcaaaggcagggagggaaugauaauugugaacaaagaauucacuugaccaaagaugguuuucuugauaugguugccacuuaccuuucaguaaaauagcacuucacaaauuuguuuaauguuuuaucucaagcucccagaaguagcuaaaaccacgaacauacauguugaaaauuucaaaagggaaaaaagaaaagaaaggcacaucugagucaggaaaacauuaacuagucuuauuucugagaaucaaaccgguggucuuuucagugaucagucaccccauuaaccacacaugaauggcacaaguaggaaaugccugcuucaauaccaagaagcuggucuuauuuagaucuagucuuauaucauugaaauaucauuagaauucuuauggaaaauauguuuuggcuguuuaggggaugcuaggggcuggaagugagaagguuucaacaccauauggguaugugaguauagaugcuuacaagaagaaggguagacuuagccaaaacuaauuugggauuuuuguuuguuugaauuguuggaggguggaugagagugaagacauauccuuuugaaacuuaauuuaauuuuuauuuauuauuauuauuauuauuuucaauuuuuuauuuuuauuauuauuauuauuuucuauuuuuuauuuuuauuuuuugagacggacucucgcacugucgcccaggcuggagugcaguggcgugaucucggcucacugcaagcuccgccucccggguuccugccauucucuugccucagccucccaaguagcugggacuacaggcgcccaccaccgagcccggcuaauuuuuuuguauuuuugguagagacgggguuucacugaaguagccgggauggucucgaucuccugaccucgugauccguccgccucggccucccaaagugcugggauuacaggcgugagcaacuuaauuuaauuuuuuaaaacaauauaugucucuuuggagucaggguguuuguuacagugauguuuugcagacagguuuauuggaacugcuugguaggugauagguuuuucuuucuguuuuuuaauuaaaaaauaagauuggccgggcguggugucucacaccuguaaucucugcaauuugggaggccgaggcggguggaucaccugaggucaggaguucaagaccagccuggccaacaugguggaaccauguuucuacuaaaaauacaaaaauuagccuggcgugguggugggcaccuguauucccagcuacucgggaugcugaggugggagaauugcuugagccugggaggcagagguugcagugagcugagaucaugcuacugcacuccaggcugggcgacagagugagacuccaucucaaaaaaaaaaaaaaaaaagauuuaugucaagaauucacauuucuggccucucuuaaaaauauuggaagacauggcaauaauuaucugggacugaauagcagcugcuucuuuuugggacaggugaucacccccaaccccaaaccccuacccuuaacucuucuacuccuuuggauguuaucccugccugguuuaaccaucaacccucuuaacucccgauccuuuuaaacuuccucuacucuuuuuauucuuagcacuuagaacccacuaacgcucuauguaacugucuuacguguuccauuucuuguuucuagacugucucccuccaguagaaugugcguucugcuauacagcagugcugugugacgcgauagcagguccuuuuuaaacaucuguugaaggagaaaaugaaggcacacguggccuugcugacaucugaguuugcaacuucuuuuaugccuucugcuaacugggaccccagugggcuucccugcuacacccucugagguuccccaguccugccaagcuguuccauccccaguuccuuggugccugcugguacuucacccuggagagcccagcccuuccacuuguucagaucucagucucucaucugggagggacagcuugagcacuaugaccugugugaagcuuuucccagugcuggcagacugacuggaaccugcuccuucauuaaaccugacagaugccuccaccuggcaguucuacccuaagaccaugaacuucuugagggagggagaugugacuuuucaucccugggacccagcagcuggcucaccuccuacugguuagugggugaugauuggauggcuuccgaaugaacucaggugucuuaaguaccguugguccugacaccauggccaccuuccagaaauuuccacauguuaagauugcagaugcaggcuggacacauuagugauuucuaagugcuaagaaaaaaaaagagcggcucacaccuguaaucucagcacuuugggaggcuaaggugggcgaaucaccccaggucaggaguuugagaccagccugagcaacaugacgaaacccugucucuacuaaaaauacaaaaauuagccagacauggugcugggcaucuguaaucccagcuaguugggaggcugaggcaggagaauugcuugaacucuggagacagagguuggcgugagcugagaucgcaccacugcacuccggccugggugacagagcaagacucugccucaaaaaaaaaaaaaaaaaaagaaaaaaaaaagauugaacauguggaauaugagacaaaugaaaaagauugaauuccguuccaacugggcuuuugaauuuauuuucgcacuuccuauuuuuugagcccgggagugcaagauguaagcuaagaaaagauaagaugaaaguauugcucuaacauucuggcuuccuucuauuagagaagaaugcaaaucuuugccuuaucucgaugaugggccccacuuaacccuuuguuuuacugagagcacuuuucugcagaugaucaaguggaauuuacuaugauggccugucaaaucuugaaauaaucuaccuuuaaggaagaaaaguuuaacuagaugauuguaccuuuuagccauaucuacaauuaauuugaauguauugcaagcuguuuaaaauauuccauuagugaagaagguaagccuagcuucugguaaauacacuacuaaguguuuauaguacauuucauauuuuacaugauuuccuuuauaauucugcuuaucuuuucauucuaauucccugaaggacauauaaaagaaccccuaaagagaguaauuacugcuguacucuuuaaccaaggcuccuuuugcaaagagaaaucugagcugcuuuuuaaagaaggccguuuuuaaauaaaaaugcaaauaagcuacuuuguaaccacauuaauuacccaccuagccucuuauuaccauguuuguauuguuugcaaauacuauuuacagucguguggaaauuaacauuacugguccugaggaaagauuguguuggggagguugugcuuuggaaccaauuagggcgaaccuugucuccacugagacucuggggaaaagcacagccuugcaaugucaaauaauagcauuagcucugacuguacaggcagagugcuguaauuauauuauuggcccuauuuugcuucugcaaugaauuucauugccugcauuguaaaaucagcagguagcaaaguuucugcuaaugauuuaauguacucucugaucauuuuggacaaaagucaugguaagauccacaaggcaauuuuaucauccccacugacuacugccugguuuaagcauuuuaagugaagacaaaacaugauucucaucuccuuguuuccuggugaauuccuucccacacagaagagagaauuacuugucuaauauauaauuucaggcauaaggagaaggugauauugcauugcaaauaauagcaguuagugggaguugagagccagcucugcaccagacucguaucagccacuugaccuccauuauuccuuauuccuugguaccucugcgccaucugugauaucagauccuuuuuucugcaaggaaacugaggcucggcgauacuaagaaacucagccaggguccgucagcugucaaguggcauugcuggcacccagauugagggccaucugacuccaaagccaccugacucuuucccauauaccacaguuucuaauacgauauuauaccaagcuuuaauaugagcacaccuccuggaugaugcuguaaauuaguugccucccaccacaccacaucaaguauaauggauauaauaugauuuuucagaauucagcuaauuaccuacugagcuuuacauuuuguaacuuuuuugacuguccaucaaaaugucuuugggauuaaaaauuuuuuucauauguuuugaggucaauuugaaucugaguuuaauaaacguuaccaugaaacauuucucccaucuuuuuaggaaauaucugugaauaaacucauuuugugauagaaggcuguguguuuauccaguuuucauccuaaggagagggggagaagggaaauaauacuucacgucuuuauugcaugccaaacguuuauagacauuauaugauuucauccuuuaauaaccccaugaaaaggaugucauugucuucacuugacaaaugagggagauggcagugcaaucaagacauacugacaaggagaggaggugagcgacuugcccgaggccacgcugcugauaccuuggcagaagcagaauuugaaaacagagcccccauauguuuuaacugcucauuggaaacugacuaggucacauacuccuccuccuucccuguacugguaguuuuucuuuuauuuuuuuuuuaaauuucuuccauuuucuuuccuuuuuacagcaaauuuguaguuaugguggagcaaagggcaguuuucacuccucuucccuaaaacuguaguuuaacuaaaaaguggccacugucuccugguagcgguugguaagccauccagucucugcaggcaucuacgcuccaggucuccagucugaggagucuggcuccuggggcaggugccucugggggucucugccaggcuugucuggucaugcagcuacuuccagacugauuccuagaucuugcauuuuuacauaggacauccccagcauucaaagaagauccugggaacuggauuccuaccagaggaauuagaaugaaaccaacaaaacuaaaaacgacacccucccccaucccccgcauccgauacacaugcaagguaauauuugaugucaguaggaaaaaaauccaguguuauaggagacaaaccauagcaagcaauggccucucacccuucccuucacacccuccacucuguccacuuguuuguuccuucaauaaauacugauggagaaugggcucuaugccaguguuucucuggauguuggcugcagggaugaacaaaggcaacuucuaggagaaauuucuguuuuugaugcucucguggcugcuuccugugucuuaauauugugcuuaaacugccacuucuucagcuguugauuucaggcacuaucuaaugacuuuugcuguuacgagcauggauuuagcucauuuuuaccaucuucccuaguuguaucaccuuccucccauuauguuuguaacuucagauuuuguauauuucgcauaugucaauauguaaacauuuuauauauauauauaugcauucacacacaugcauacauauauguaaugguauauauacauguaaguuuccauuuuugcucaaauugcucuggacaguucuuugcucugggaguucuuuacucccuuucucauaagaagaggcuguuuguacccugaucaaucccucuaccucuucuuuuccccuuucacccguaacuucugcuacuuauacuucugccuuaucaugguccauaacauucaccuuccacucuguagccauaauuaaaucucccaugcaucccacuuugggaggcugagguggauggaucaccaggucaggagauugagaccauccuggcuaacacggugaaaccccguuucuacuaaaaauacaaaaaauuagccgggcaugguggcacgugccuguaauccaagcuacucgggaggcugaggcaggagaaucacuugaacccaggaggcggagguugcagugagcccagaucgcaccacugcacuccagccugggugacagagcgagacuccaucucaaacaaacaaacaaacaaacaaacaaacaaacuaagaacaacaacgaaaaaacucccauguauuaucuauggauugacuguaaaauaugagaagcaauaaauauguucaucacuagggccaucuagaaauuucuaacccaagggucaacuaaucuuucccuguguuguauuuccugcucugcggauccggcaucaugaccuuuguacuacccaggaaagccaguguucucaugggcucuucucuuuuuuaugcucuaccagaugcuagcacuguggcaugccauucgcucacuagcagcuuaaaggguacagguucuaaaucuccuuagugcuacucaccuguuauuucugagccugcguagaugaucuucuuuuauucagacgucugugucacauauacaugacauccuacccccuucccauaaaaaaaaucacauuugugaaugucucucuuaggcugaguuccagacuccaagaucccucuucucucuugucagaauccagcagcugauggcauuuaugucuguagauuucacugucaaugagucauugacaggcuaagcaggcuguuggauggagugaucaaugguaugagggaaaacacuaauguaugcaagaagagccauuuccuaguaggaaaaauauuuauguauggagccacaaaggugaucgcuucaguagaaaucaccaaggaccugguagucaaugugcaaccuaauuuucuuucaaaagcuguaggaauggcaagggaggaaauaaauaaugcauuucuuuauaucuccuguuuuaaguuacugagugucgccaagagauuucuaaggccagacauugagucagcuguaaaacuggaaggagcaauguuugcugacuguugccucagccgcugacccugaucuccucugcacguaguaggcagcuuaaaaauuccucgcccgacuucugauuuucacgugacucacugcuuaguugucuggguuuguuuuaauuccuuucccccugcugacaguucuuuaaguggaugucuauaaagguuggggcauucgcucuuacaacaauaggaaaagaaaggaggaaggaauaaaaaagagagaaaaggaauaaaaaaaaguuugguuuagaugucugauuucucugagccucaguuucccagcauguaaaauguugugagggcucacacuggucuuguccaggugcuuaguagagcauccauuacaccauaaaguaucacaaaaauuuuuaauaucaucauuauuacugugcuuucccuugaguuuuuuuuuuuuuaaaucaguuaauccacauacuggcagaucugacuuccuuguuuuaggcccuggggaauuuuuguuaucuguagagcuggauuaauuuuacaguguggugccuuugcccaaggugaaccugucuguuuauagaaagugucaccaaguucugucuugggcccguccacucgguuauaugugcuggacccuggguggaagcacuuugcacgugugcauucacgaugggcugugcuggaggggaaaacaggcaucacucccaaauucuauucaugcaauuaaaaauuccuuucauuuuuauuugugagaggguaugggugcacagcagacggcaaacagaagaaaagcuuuugauugaaagguaaacauuuacuucugccuuuuaaauagacauagcaagucucuuuacucucauggaagcaguuauaaggaacauagagcugaagagaauaugaccauuucuggucuuuuacuaugcucguauuaauccacccuggauagaagggacuguacuauuuggaaacaccuaaauaaaauguuuuugucuuaagguguuaaaauguacucauuaauguggcaguguauuccuuuucuucugugaucguugaaguagggaaggaauuucaacuaagaaccaaaaugauugucuguuaagacacuuauuuuuugagaagacaaauuaauauaacauuauuauguggggaauguggaaaggcuaagguuguauugaaaacuuauuaagcuuaugagaauauugaaagcaugaggaggcaugaccggaagguauuaaugauuugggcuugauuauucuaagacuguauucuaagucuaaaauguugauaacuaagaccugaaaugauaaauguuuggcaaaaccaaauaaaugaguagcagguugaaaaaagaggcaagagagaaguagauauuuauaguuuucuaaaacaauuuagucccuucuggaagagaguccuaccucagccaugccuaccagguuguguuugugggauuauuucugagucacccuuaagcucaucuuuaccccucucccagacccccaguccccucacugggcauuccuuggauuauuuauuuauuuauuuauuuauuuauuuauuuauuuauuguuugagacagucucacuuugucaccaagucuggagugcaguggugugaccuugacucacugcaaccucugccucccagguucaagugauucucuugccucagcccccugaguagcugggacuacaggcacgugccaccaugccuggcuaauuuuuuguauuuuuaguagagacgggauuuugcuauguugcccaggcuggucacgaacuccuaaacucaggcaguccacccgccucggccucccaaaguguaauccuggauuauaggugugauccaccacacccagccuuccuuuuguuuuugauuuuuccucuuuaaacucuacuuguaaccaccccuuuccuuucccaaacuuuuacuagcuucuuccauccuggacuugcaaucuggcugaaaaccugcuaaauaagggaacaauuuugacauggcuccuguacuccccacaaaccuaguugauuccagaccaguaaugucuuggggacaguguugucccaucuuccuuucuaggcugggcucagauuacugacguggaagaguuguugguccuggugcaacaugccaugaccaugaggccucugguagaaaggaaggaaugaagggugguucuccaaacccuuggcccaugccucauccuucuguucccuuccuuuuccagguacguagcuggucagguuucuuaaauuccgucgaucuggcuuuauccauuuuaagccuuagguuguuggaacauagcuaaguuggucaccuuuucaagaauugaaucucaaaaaagccauguagaccucgguuguaaccaucacauucauugacuugguuguugaucuguuugucagaucaguuuucuguuuggggaacauuuuuguaagugcauguauuucagcuuuuaacauuuuaaaaauaaaauuucauugggaaagaaauuucauucgacuggaguaccaggaacuuagaaugaauccauuugucagcaguauuuauacccugucuaaaagaguguccucccaguucucugucucuguacuguguccccacuuuaaaaaauagcucaaccucucauuauauuugcaauuuuuuguuuuuuucauugccugguggguuuuuuuuuuuuugucuuuuuaaaugcuccauguagaaaagaauuccuggaauaguucuuggaacagcauaggugaauaaaugagcaauuauuuuguccucagcacuauaacugauuugagaaggucaaaacagaaaauaaaaacauguuucaguaguaccaguuccugcacaggcugucugccaacuauggaaguaaagggaauagaauuaggcugucuggauuauagugggaaaacaaaacacaaucacauccugccucagccuauccuugaacuggugucuuuagaaaggggaggucaaguaaaggccauaaggcuggaugguggggaagaaagaggccugggaacaggugagaaacugcagagccuggcggaguucauuuaaccucacugugguucuguuggacuuagugcaaaaucaagagacccaccuuugccugcccauccugcaaugguuuggggggccccaaguagaugacuggggaagaugacugggaaacugcagcacugguucauguucugggacaaaucaauauuaagcaaguuuaaugauggguagguucauucaaaagggaaauauguuucaauggagaagagaaauuuguuagguuguauaauaaauauuuugaguguauuuggauagaaguuuaugacggaaaaggcaaaauucucugugucuuuauggggagauauucgauauguuuuuucuuggcagaaauaaaacauauucaauaauauaauuaggcaaacuuguuuuaguugacaagaagaccguaucuccgucugcaagaugaaggcaagaucaagagaugucaguuaacauucuugcgaccacagguagggaggagaacuggggaggaauuuauggauaggugagagcauaaaacuagaugcggaagggaugggggagcagguaaaauaaugaggcucaauguucaagaaggucuugggcaagcgcgugcuaguuauuuuccucacugguguggucgugacagaugaaucacauuuuacucuccucccuuucucauaguaugauuacauaaaggagaccuucccuggaaagagcccugugcauggcuuuugagagugggccugggcuaacagugaguguggaagcuugcugccuugaauucuuuccaauucuggagaguugauggguaacaaguguguaucuauagucugcuuggacauggcgguguggccacugacacguugucagccauccccucaacuccagggacaggaauggugagaagguggugagggcacagucugcccggagacgggacaguuuguacuaccuguagcaagagcaugucuuugagagccauagcagcuggcuuccuauuuggagagaacaagaaugugaaaagcuauuuauuaccagaugugggcagacccuccagccuuuuuuuguucuuuuaaacccuaaucucuuuuuaaaauuuuuuuuauuuuuaauguuuauggguacauaguaggugcuuauauuugugggguacauccgauguuuugauacaggcaugcaaugugaaauaaucacauaugaagaaugggguauccaaccccucaaacauuuauccuuuguguuacaagcaauccagucacucuuuuaguuauauaaaaauguacaguuuaaguuauuauugacuauagucacccuguuguguugucaaauaguaggucuuauuuauuccuuguauuuuuuuguacccauugaccauccccaccuccucaucaaccccccacuacccuucccagcuucugguaaccauuuuugugcucuccauuucugugaguucaguuguuuugauuuuuagauccaagaaacacaaucuuagaugcauaguaggugcauucuguugccaucugcaucaugggacugcacaaucggagaggcaggaaggcccugagaaauaccugauuacacaccugcgugcugggaugagaaauaugaggggaggagagaaaagaugagccucauauugcauagcaagucugugauggaagcaaaguuagacccuguugauuuuuaugucuuaccuccuugccauuaguuagguaaauuuagaccaccauauuuucuaagaucagagaauagagaauuuuaaauucuagauucuugccuuguggauguugaaaagaacaauuaaaaguuauuugggauauccaaucaguuaauaaauaauuaugaaugaauaaacuguuuuguugaagacacucuuauggcagacaugaacauggggcuuaaaucaguucugacaucuagaagcucaaauccaggaggcagaggaguuggauauuaaagaacucuguggugagcuggacaggaugacaugacaauuauggaaguucagagcacauagcagucuuuuccagugauggggauggaaugugggggucauggaagacuuuguggaagaguugcaaguagaauuauuacuguugaaaagagauggggaguuagguagacaaacagaaaaaaugccaccaaacaauaaguuaggauagaaaaacuccacguauccauaugucaguuggcccaucuguucguucauacauccuuucauucuucuauccauccaaccguccuugcauccaucuauccauccacacaaccacuuauucuucauucaucugcccaucugcccaccuacccauccacccuuccauacauucaucuagucauccccauccauccacucaucuauccacccauccauccacccaugaaucuauccauccaucugccaauccacccacccuuccacucacccacccauccauacacacuuccaucugccuuuccaauuauccacccuuccauccauccaucuacccacucaucuacccuuucauacauccauacacauccaucuguucauucaucuauccauccaugcauccuuccuucguuguuuucuuccuucuauccaucuauucaucuacccaccccacccaccuauccuucacccaucuggccauccauccuucuacccacaccuuccuuccuaccuuccuuccuuccuuccguccuuccuuccuuccuuccuuccguccucccuuccucccauccucccuuccuuccuccugucuuccuuuccuuuccuuccuucucuuucuuucuuuuguuccuuccuuucuuuccucccucccuuucuuuccucccucccuuccucccuuccugucuccauuauuaacuugcugguauuuuguuucaccauugcauuguguuuaucaauagacgauuaauggaagaagagaagaaaucaggugaagucuuuguaggaucuagaaugucuaggcuaaggaguuugaaauuuuuuauacuauguucuauugggaaccauuucaggguuuugagauauaguaugauauaauaacagcuaugcuaaauucuuugaaguuauuggugguggaauaucaauccagaaugaaaauaaauaauuuuggaaaugagccugucauugaaauauacuuuauuucucguuaaaugucccagcaaaaguauuuugguuguuaaaauaaaggaacaaccauuagaaaggaggaggagaagaauuagaaggaaaaaaaagguaaagguaaaguaccuugguauuuuaggguuucuaagauuaggaacuuuaaauguugaccccauuuuggucuuuaccuucaaaagacgggagaaagacugagagaaguuucuaagcugaugcugcucuacuaccuggaguaggaaugagaaaccaucuauaaauauuaccuuugguguuuccaucaaaaauuuagaauuucacccuauucuauuuuuaauucugguuuaagacugaagggguucuuggugaauacuuuuguagauacaauuaauaguuaugaaaaucauuacugauuaccuccaggguucagauauugggcugaaugucuucucucaccaucagaacuaccuuuugacuagaguguuaauuauuaacauauuuuagauuagucagacaacugcaauauuuaaggaauacguccaaggucacacaacuaaaagaagugacaaaguacgguuucagacccuuuuagucuuuucuguguugcaaaauugagauaaugauaauagcuaaugauaccucucccuuacugauaauugaauguuuuaugugaauuaaaaaguuuaaucugcauaguguuucaucaagauagauuccuuguuauccucauuuuggagaugaagagacucaggcaugcaaaggugaaguaauuuucccagggccagagggcuaaggaaagggagaauugggauuaauucuacauugucuacugguaauaccuauugcucauuuuuaccaguuaaaacuauuuaaugagcauuugcccacuuucuaaaaauaugauggucuuaguuacccacauggaccuacucuaucccaggcagaugccacaaauuauuuuguuuucuuuuuguauauauuuaugcuguuuccucauuuuuaaauagugggcuuugaugacuauucuucuacauaaauuauuacauaucuguaucauagaaucuuaaaaauuauuugauucaaguguauacauaauuuucauaucccugauagauauugccaaauauuuaccagaagugaaucaaguaguuuuucuaccaacauuaucuaagagggcuugucuuuuuacaucuuugucagcacuaaguauuaucucccuuacuuuuuuuuuuuuuugguaaucuuuguuacuuuguuaggauuaaaguagcuucucauuuuaauuuucacuccuuuaauugagaagcagaacguauucuuuuuuggugacuuguuucagagucucuuuaguuugaagauacaauagauguagcaucugcuauauccgguaacaggauaacagugcauugcugggaugaugaggcugcagugggcugugauugugccacugcauuuucagccugggugacagaggaagacccuauuacaaaaaaaaaaaaaaaaaagggucuguuaucaaccaugcuuuuuuauuuuauuuuauuuuauuuuccuguuucugaguuagagucucuuuugcucaggcuggaguacaguggcgugaucuugguucacugcagcaucaaccuccugggcucaagcaauccuccuagcucagccuccugaguaccugggauugcagguauuugccaccacgcccagcuaauuuuuguauuuuuaguagagacaggguuucgccauguuggccaggcuggucucggacuccugaccucaggucauccgcccgccuuggcuucccaaaaugcugguauuacaggcaugagccucuccaucuggccucagcagugcucuucuggcuagcuugaucauaugccaauguuuuauuccuucguggagcucagaguaagcuuguuuuacuggacguuuucuauaauaaagcuaggggauggcgaaucauucuaauuaccaaaaagcugucuuugauaacaauguaggagauaacgaaggcagaaauaacauuugaguaauucuuugccauucugucucugaaucuugaaauaaauacucuugaauuuauauguucuugguccuuuaggagucauaaaaacauaccguuacauauguauaugaaacggugagaaacugcguauuuauuaagagucacgacccuuaggacuagacaaaucaaauuaaaucucauaaaaaccuguuauggaauaugaauacguggcacuauuuuuucuuuuagggugucuuuauuaauuuugucauguuuaauauguugcaguugcaaacaaaggcauaaaugcaugcguucauuccuaauuaauuuauguaauuggguuuuauaaauuuagcuguuuaggaagcugugcauaacacacuccauuuacugugugcuguagccaauaaaagcauaauagaaagaaauauaguuugaagcucacuucaaugguaaauauagauuaguuguaaaugauaucuuuguaauguuuauuuuaaauuuugcagugcugcagauuuucugaacauaccaauuaauguucuuauuugaaauaaugacuaguuaauuacuauaaauucuaagugcuccaucucugacaauuaaaaauugucuuacagcuuuuuauuuauuuauuuauuuuuuuuagaucuuuccaaauuauauuaagugcagcaucuggggaaagaagaaugggaauggaaggaguguguuuaaaaugugggugguuuugucaauuccuauugggaaugcuuguauuugaauguauauacauaugcauauuuauguguaaugucuauuucaugcuaaauagggagugaucaaguugaaaaauaagaaaugcuguuugaauuuuuaaaauagguuauaaauuauaacaugaaaaucaaauacaauggguaaaaccaguaaauuuuaaauaaguuuacauuuguugucgugaugugacugugacguuaccugagaucucagcaaggagcucugcagcccgaaaagaccaacuggaaugauuugaucagaaagggaauggguauuaggcugcuccacugauacuuuauccacuucgggagagagagcccuguuccuucuucaucuagcucaagccaacugucagaaaugcaugucagagcuacacaauucuauccaaggcauuaacuguugucaagucuguuuuuuaugaauauguuucaauauaagaaauugucuuaggcccaaagugaaacgucuuccuccuugacucauagcaagcucaugcagguauuugaacauuguucuguauaauaugugcaccuuugagaaaucccaugauucuugcuauucuuuguaaaucuaauaccuuccauccagagagagaguauacauguggagucaauugggaguaccuuuuguauccucuagucugagccuuacagguuaaaggagaauguuggauuugcuuuugaaaguaugggcuugcggagauuaaaaaaaaaaaaaaagaaaccuugaauaaucauguacaaauauaaauacuguauguagaauaaguguaauggaucacauuuaugaugaaauauguaugucuuuccaaggguaagaccuucauaauucauuuauaaguuaccuucuuucucuuacauguaaguagcagaauaguaauuuucuucguucuuucugaagaauugccacacagggaaugaaaagaagaaaggauaaacuuuucuuaaacagcagaauguuauucagagauaacuggaaaaaaguacgagaaaagccaaaaagaaaaaaaaaaauuguggguccuggugauguuggaaaaaugacgugugagcugaaguuccagacgccgagcuucaucuauuuugucauguuaugacagaaaucauuacaagggugauagguuuauuuauaaagacuugcuucaauauucaaaguacaucuauucuagcauuccucauuuugagccaggcuguggaucaagaugaaagaaaaauuaaauuguauauugaagagcucuuaauugagccaugcuguauuuaacagggaagcaucggcuucaggcagucgauaccacugaggauuuuuaaugcccugcaucaugagacugucaguuugcuuuggagaaugcaaacaggcuaaugacaaagcccugcaaacuuuuguaguugcugcuggucucuuuggaaggcaagugcuaauuuacccacaguugaaaccugacacacacacgcgcgugcacacacacagacacacacucucucucucuuucucugucucucucucuuucucugucucucauaaggaacuaaauccugcguuuucucaccagagggcuaaugacacacugcuuagucacccaaaaccuguuuccuaaggagccacuuuggggcuuguuuaaaguuuuuaauguaaggcauuauauaauauuagauuuccccuguuuuuccuuaaucaauguaaauucaauugcauuucagaggguggccaaguggcauuucaucaucucuaauauccauuuaaaaauguuaggucuacccaguuauaauucuccaaaguagccuaucugugguuuaauauguuaucuacauucucuaaggcaguguuaauuuccuuuuguaguuaaucuauccuacuaccaaauuuaguauauuuauaguuaaagauucuguuaagagcuaagugauuuaaguacaucugggauaaaguggccuuggcuuuaacuaugaaacaaauuuucuuuauuucauucucuucacugauaaauccauaguaacuggaggcauuuuuagaauugugggcaauuucagccucuaaaguuugauuaaagauacuucagauauuccuacugagaggcuagagggcugaaaggaauuuauuuuggguucuggcccuagugcagcucaguggaagagaacagacauugugaguuuaauucccacgcugccaauuucccacgagucuaggguggguguuacuucucaagaaggcgaugguagaaccgcuggagacuucuuauggcuguggcaggggacucacacgucacaaggaguccagaggcauggcuuugaagagcucuuuucauucauucuuccuuuuguucacuuguacaucaaauacaugcugugggccuacugugugcugagcacugaucuugucagguucuuggggaagacuucauugcugaggugaccuuugagcugaguguaugagugcaagagagagcgaucacaccugggaacugcuuaauaaaguccccggcaucuugaagccacuugcagaccuuggcaguugcuguugcuccugcugcugcugcugcugcugcauugucaagacuacauugaugucuuggaaauauagaaaaaagaggcugcuggacugugugcuuagaaucagugugcuaacucuguuaccaacaccguagagaagugguuccagaaggaagaguucagggugagaaugaauaacggaguggcuuugcagugggaaccuggcuuugcagcacagcuaggauuggagaagaucuucccagcagggagaagaacucaaagaacaugcaugaagggaggaagguugcaccagugggagggaccagaauaugguguggaaagaacgagguucaaauccaggcucugucauuaacugccccuacccucucugagcugaguuuguuuuggacacuggagauaaugcauguuaacauccugguagcucuauuuauuugcuaccaugguacauaaucaugggagcucuauuuauuugaacaucuucuuuuguuauuauuugguguauuugggaaaggcaugugggagcagcaagcaggugagcauccuguuuggaaugcagggccgggaacugcccugcccaguccagccucauuccagaggcuagcaccuggccucagcuguagagcugcugggagcauuucagcucucugcuucuuuggcagucuagugcugucacagaaggaaagcucacuccauggaaaaggggggauugauuucuucucugagggcagaggcugaucaaucuaggcugguaggaauagauguaaccucagaggaaacaauuugcauuggcgaaagcaagucaauggccauccccaaauucaaaaggacagggaaguguaauccuacugugaucccuaaagcauccaggccccaggaaugguggugauuugccagggggaaauggaggaacaaccccuucuuugacuaccucuguaguuuauauuggauucugcaaagucccaugaggacugauagaugggcugugucugcauuugaauuuuguagcugaaaugugggugaguucaccuagguccccuucaugacaagguggugagaaacauuuucuuguucuacaaaucugaauuagguccacgaaagaggguaugcagcauagagaggaaccaaaaaggacgcaagauuuaggauagauauugccccuugggaggccugccuggucugcccuugauaacucaugaacagucugguaaugcuggaaggcaaaguaaaagccaaccucuugagaaagacauggaacacaggauggaacuugaacugcuuaaaauggcuuuucucaggccagcugcacuggagugugcugcuguaacaaacacgcccggaucucaguggcuuagcauggugaauucauuucccauucgugauaucugaccacagaugggagguaaggggcugugcuuuaaagucauucauggaucuggcugggcccgaugccucacaccuguaaucccagcaacuugggaggugggcggaucacuuuaggucagaaguucgagaccagccuggccaauauggugaaacuccaugucuacuaauaacacagauuagucagguauggugacgugcaccuguaaucccagcuacucgggagacugaggcacaaggauugcuugaaccguggaggcagaggcugcagagagcugagaucaugccacuguacucuagccugggugacagagcgagacuguaucucaaaaaaaaaaaaaaaaaaaaaaucuuucagggauccaggcugaccucagcaccaucucuuacaugugccucuguucuuucccuaauauaagggagcaugggggauuagugucuggcuuaagcacuuccacucagaaaucuugcuucuccccacaauccauuggugaaagcaaggcaauggucaugccccaauucgaaagauaagugcaguccuacugugugcccuaaagaauugaagaucaggauacuuaugagcagcgcucacaacugccauaguggcaaugcgaauggcaucuauuuuuaaugugacugagaaaauaauuggucagauauugcaggauuuuugugggggagaggguggaaaagaacuuacagauuaaaaaaagaacuggcauagcaccuagauuuuaaacagaaggaaaagaugacauuggggaccagagacagaaauuucacuucugugccaugacaaauaccagggagauguaauugcaaaaugaagcugcaaaugucuuacccagggaacuaggugacaaccugcuuggcuucaugaagaaggaauaauauccaauuaggcuaaguguauucggugccugagugacaagcccuggagaccugagggcuucuggggcccccagggcgguuucaggaggcugucuccagaccuguccggggugugagcaugucacgcuguggcccgcgccuccccuguacagcugccucugcucuucuaagcacugaaaugagagguguaaccuguguuccagagucugcgccucccagccacuggggcaggggcaccuggcccaucagacuuaccuugccuccccugcugcccaugcccugcugccuagggcugggcucaugacuggguccacaucagcuccacauugcagacugacccccuggacccucacgucucaggaucccuaucucccugucagugcuuugucacccaaagucaccgcagcuccucuugagugcuuucaagaucagaccgagggguccuaguucaagcuaauuccuaccugugcgaucacuagccaaguacugaaccucucugaacuucaauuaucucaucuguaaaagguguugguuuguaauuguuccuaccucuuagggcuuuugugagaguuuagaugauaaaccaccaagcaacaguggcuggcauucugugcacaaucgaagucugcugcugucagcucuguggucgcugucugcacucccaccccugucauccuccaagucugaucuccucccgaagucucuuccuggaccucagcccucagggauugcaccucccucugaauaugcugucccuucuaaucaugccauuuagccacacugccuagcacuuucuuuuuugaauauucgugucccaggucccugaaaaaguugcuaagccugcuaaaagcaaggcaaggccuuucuuucuuuguaaccuuaaugcccagcaacgcuccauucaguuugacccucaguuggcuucauacuuugauuuuaugucuuuauuuguuucuuaaugagcuacuuuaucauugugaaaacaguuaaauaucaauagucaaugaauaaauauuaccaaaaaaaaaaaaagguuugucguuuaaaaauuuggagcugggcuggaaacuagggauacuacuugguauauuuuaguucuacugauaugacaguauuugauacuuaaucauauucaagcagcuuuacagagacuaccaugagaauggguuaaauuaagaggauugucuuugcuguuuagccaauaugggccaaaguucagugguuugagacauggcgggguuugguaguagauguaggauauugcuggggaaagaguguuagaggauggaagauugcaugauauuucuggcuuugcucuuugacugugugcuguuuguaaaaucacuuaagucccaugggucauuuucuuccccauaucaagcaccugcuauguaucagguguugugcucacgugguguuuuaugcacaguguuuccucuuuguuaauccucaugaugauugguaugguuuggcuguguccccacccaaaucucauuuugaacuguaaucuccauaaucccuacgugccagguagggaccugguaggaggugauuggcccgugguggcaguuucccucaugcuguucucgugauagcacgugaguucucgugagaucugauaguuuuauaaauggaaguuuccccuggccuucauucucuuuccugcugcuuugcgaagaaggugcuugcuucugcuuugccuucugccaugauuguaaguuuccugaggccucccuagccaugcggaacugugagucaauaaaccucuuuccuuuauacauuacccagucucggguaguaucuucauagcagugcaaaaacggacuaauacagguugggcacgguggcucaugccuguaaucccagcacuuuaggaggccgaggcagauggaucacuugaggucaagaguuugagaccauccuggccaacauggugaaacccugccucuacuaaaaauacaaaacagccggguaugguggugugugccuguaaucccagcuauuugggacccugaggcaggagaaucgcuugaaccuggaagguggagguuucagugagccgagaucaugccacugcacucuagccugggugauuccaucucaaaaaaaaaaaaagagaaagaaaacagauuaauacaaugaucugugagauauugggacuguucuuauucccauuucacagaugagccacuaacuggcuccuggcaggacagugaauaaggggcacaacagagacacaaacacaucgcuaaccaauggucucauccgucagccacacugccugucucagcaugggcccuguguggaccauuccaucucaauuuguuucugauucuugucaauuaaauaagaacagcugaaaaguaaaauaauaaauauauacauaaaaacaauggggggaguaauaaugauaauagauacaauuuuuuggucuuuauaauccccagagccuggcuuaauuauuuuaaaguaaaucaacacuuugaacacuugcagguuagaaaaccaguggacugauggaugcguuacagccauuguuuccaaguguauuaguuucugcuggccgcuguaacacauuaucaccaguguagcaccuaaacaacacaaauguauugucuuucaguucuguaagauagaaguccuacaggguucuccuugggcuaaaauguaguuguuggcauuucuuucuggaggcucugggggaaggucguuccuuggccuuuucccaugacgcuagaggcugacacauuccucugcuauggccucuucauuuuucaaagccagcaagauugcaucucucugucuuucuuuuguggucacauuuuaccaggacucuucuccugcuuuuuuuuuucuaccuuuagggaucuuugugauuucauuuggcccaccuagauaaccaggguccucucccuauuuauuuuuauuuuauuugugagacagagcuuugcuuuguugcccagacuggagugcaguggcuugaucuuggcucacugcaacuuccgccuccaggguucaagcgauucuccugccucagccuccugaguaccugggaccacaggcacaugccaccaugccagcuaauuuuuaguagagaugggguuucaccauguuggcgaggcuggucucaaacuccugaccucaagugaucugccugccuuggccuccuaaacugccgggauuacaggugugagccaccacacccagccccucucccuauuuuaaugcgagguaauuaacaaccuuaauuucaccgguaaccugaauucuccuuugccacgcagucuaccauauucacggguuucagggauuaggaccuggacaucuuugguugggaaaugggcaucauuuugucuaccacaacgugagagcccauugcccugcauccacagucauaaaagucuguucccuuccucccugauucuuccuaacuucuccugccugccuugcaggauauguggaguuaucaguuccuagcaccacuggccaaagcgaggauagcugauugcacuccuacuuuccugcugguggaaacagcauguauauagguacaacucugguguggggaaaaugcuaaagauauaaaguagaaauagccuuugugugaugugagcagcagaacaaaaaucgagggugccaaauaaucguaugaaguggugaacugccuaagauggaauauugcuguuccuaaauccuggcuguguugagacaugugauccugccgaugagaugagagcugaaccacucucuucucccagaugcugggcuuccgaccuuaauagagaccgagaaacuuaacagagggcucagaagagaaaucuauugaaaguuacuaggugccaggugucucggaaaguguuuaacacaugccugagacguuaaaggcaagauucaugcauucuuucagcagacaguuucuucacuuaccggggaaggggguguaauauauggggguauagggauaaauaauucugugugcugugcaggccguggagacucaucuucugcacaggucaaguucugaagucagcauauaagcuggaaguggagugaagucaaaugacccucaaagauccuuccagacuucaugcccuuggcaacucaguuuggacacucauaugcugguuucuuccuuguauuuaugcagcagccuccuuuuccacaaaaagcagaggccaacguaucucacccccucaauuuuuuuacuuucccucucccucccugugcuugccuuucuuuucuuuucuuuuuucuuuuuaagacaggcucucacucuugucacccaggcuagaaugcaguggugcaaucacagcucacugcagccuguaacucccagacugaagcgauccuccugccucagccucccgaguagcuuguacugcagaugugugucaccauaccuggcugauuuauacuuauauuuauguaugugcauguguguuuauauauauauauuuguagaaaugggauuuugccauguuucccaggcugggcucaaacuccuggguuuaagcaguccuccuccagccucccaaagugcugggauuacaagccugagccaccaugccuggccuuugcuugccuuucuuaaugucuuugacaauucauguaaauguguguaugauguaacucuauaggacuaagggugugugaggaugccaggaggcuguugguugacaggagucaugauuugacuauaugaggucacagaaaaugcuuuuuaaaauuuaccgccaacccacaggaaaacuauucuccuucuucuaaggaaaaaaaaaaugucacgauaaagcagcuacauuaaugacaggcacaucaagguuuuaacguguucucuagauuuaugauguguagcguggucuccauucuagaaagcaaaguagggaaagcacgacuuuggggccagggcccuuucugguucagaaugucccuggccagugugcgccgugcaguguggaagcacgcuucggugcgcauguaaguuuacgugcuaucuguagggacagugauuuuuauucauuagaguuuuugagucuaauuguuuuuaaacugccacuuuuguuuguuaaagauacagaugucuggccauagaggaaagcaagguggauuuaucguugcaauuagaugcuucacaauuugaaaacuuaucacuuaaauuggugaaaugucacuuuuaugcaacuugauguuuagaaguccuuggcguccaggacuaaagucaugugcaauuuaacaagaucuuggugagauaaaggaaguugcgcuugaggaaacauugaaacacaccagauggaauuuuccaauucccuccuacaugauagagacuaggugaagggagauagaccacaaauugauuuuguguaacucuuaaauuaaguggagcagaguuaaaaaaaaaaaaucacuggauuugaaguuggccuauguuagauuacuccaaggaaguuaguuaauauguuaauaugaaucuagaugaacauugaguguuuugcucuucuuguuaauuugcgccaucuacuaaucucuggacaauggagaaaaagucguagguuaugaguuuuuuauuuauggacauuaagcaauaucuuuaaaauguaaaaugaagccgacaaaaugcacagccagauaacaacaacaaaucuaaucuaaagugacaggaagagacucucccagacauuuuucucuuuaauguaacaugacuuuaaauugaugcaaccccacagugauugaaaaacucucagagcuugucuccuaugauuacauuucugaucuguacaacuuaauuuuuuaacucggugagucucaguuuugcgaaugaacaguucucuuuugcuuucucucucauauuauuugggaagacauuauuuggcaaccaggcagauaaagcucuguuaccacgacgaauacugagaaguccuaaaacaauaaagaccccaagaacucacccuggaauauguaccuccaaaucucuucucuuuuccuucucuccuucucuuuguuuuucuuucucuuccuguucucuuguuuuaucuugacuucucucgacuguggugacgguuugcauauaucugcgauuguacugaaacuuaccaaacauuguacguuuuaaaugggcaaaauguauuugaacuauauauaucacaauaaagcuauaauacucuuuuaaagugucuccugaaucauuaccaguauaauuauucugugaacuguauuuugaugaauucagaauuaauuuaaaauggauuaucccccuguagaaugggagguaaugcugaaugauugugaaugauugugaauguuuguuuauucgggguacucccucaaauuucuuauccaguggugucuagaacauguugggauuuugugugauaguuucuugaguuggaaauugcguuucuuuggccucccauguggguaucaaugaguuuuacaugguuuaaaggccaguuaugugauggauacuucuauuaccuuaugucuuucugauuucauacacuuaaauguacaguuuuuaucuuccuucaaaaccuuauuuuuccgagcaaguuuuauuuauucacuuucagucauuacugaagugaauaacaaacauauaacaaugcuauuuugggucauagcuguuuugcuaaguaauacuuaaaggcuuucugacuauauuuuuaauuucucgacagucucccaugguuauuuucugaucauaacuugaaaaucaaagcuuucuguucaguuuaaccaucuuuuaaaacccagugguuuuagcuuggguauuaaccuuuaacauagcuagcgaaaauugaacauuuuuauuugaaauaugcuuaauguugucuuguguaagacaaaaaguuuagggacaagugaaccauuuacuuuucuuuuaauguggaaagcaguuuacaaaugcugguaugacuaacaagaaugaaaggaccagaauggcaguucugagcuagaaugugaugaguaaguaccaccauaguuagcggcuagggaagggagguuguucuacagagaaacaugcccaucauuucuucuguuaccugguauucacucuggcaauuucuuuuuggacucauucuaaaaucaggauuaaggauauccacugagaagcuugcauuuauuacucuaagcaagaaacuucuauuuaauuuuuuaaccauuugauucauauguauuuagauuuuaaaauuucauuuucucuuauccaaauguaucauauaucuuuaaguaggugaaucuuggaguagauuuuauuauauaucacaucacagaguuaagcucgguucaucuggauuuuaaaaaucucuacagcuuugagaaugacuuugaaacacucuuuacuguuggagcuuaaagaaaauaaaucucuaauguccucuguauuaauucaccugcuuggaaaguuagagauuaaaagguuuaguaggauuuuuauauuuucuauaauuucuauuuguauuggaguaaacuguucguuguauggaguggcuuagcuuucauaaaacagaaagauuccuauauugagaaaagaggaagaaggaaaaaguguaauauaaauacauaaaacuuccucuagcuuucuuguguuauguguaaaggaguuaguacguuacuuuaauuguguacuuugaagaaagcaaucuccuauuuccauuaaugguggacucuguggguagagacauggauauuuuuccuuuuauaagaaaggucuugucuuuccucagaaggcauugugagcaaaauaagggaagaaaaagagaaguagauaagaaaaacaaaucacaauauugaagcaggacccgaguacuauagccuuccucauauuuugguaucuggaaccgagguugcuaauuaaugacccaagagcuaagccuuguuugaugaaaugcaagauguaauacacagauugccuuggagugaugugugauuauuaccauccauucauguguaaucccguauuuggaagguuuguaauuuguuuuugacacauuucucucugauuuuauacacucaugcauacaggucucaccucccuccaaaaccuuauuuccaaagcagacuuuguuuguuugguuuggguaauucauugggcccuauuugucuuccuuauacauaaucuauuuucuuacugcugccucugucuuccaaaccaagaauauaaagaaugaagccuggggacuggaacuuaaaacuucugccgagaaaagaaagucaaggccugugggcuccuaaaacauccuguggaauucgccucagaugccccuccauuugcacugguauauggaggauguuugaaaaccaccagaaccuauuguguacuuuggaacaauggcauuuuccugcuugauugugaagauggccgcuggaaaagaagccaacucccagggggcacgaggggcuaagcugucuccugggaaguuugagggaggccaaguguuuuccaguucauuuccaacgcguauuucuucagggccaagggcccagcugugccucauuaggggugagaguuuggcugugacacgacuuaauagaaaaaaaaaaaaaaaaggagaaguccaacuagcugaguggcaacagaacuugggacaaccugugcccacagccuuucauguccuguaaugagugugccauuugcucacugggaggagaaaaaaaugacaguaugcaacagucaacuuuuuccugaagaaagagagaaaaaaauacauauuuugcagccgagacaucgggguaccuguuaacuuuaggcacagcgcuagugucagcccuggaaagagacucccugugaacagcacuuuuuaccauuuaaucagccuguacuucuucguauuuauagcccuggcgaggcuggcccauuguuacaagaggaaauugugauguucagcaguuuauaccuugggagcuggaagcguuucuccauggugaauuuguaauauuaauuggccaugucaguucaugacaaauguagugacaucuauuucaaguauuucaguuuuauggugcugaagaagugacacgcgcuccagauaaguaaucucacaaaagaucuucccgcucgcuguggagcgccuccagaacaugcucucagaggagaugcaaauaggcucaggguucagggggcuguccccuuccuuuugcucaaggcucagaggggagccagaggaaugcagggagggacgcacucccugucauuccccuuucagucucaggagauucugguugaagcucuggcauggacuuuccugcccaagaaguguccuugcggugaucauuuaugugauuuggguaccugcugcuuguaggcugugacugucaguagcagaaauaaauauauugccuuucucacuguguacaguggugcuguaccaagggugacucugcccaucaagggacacuugucuggagauauuuggguugucauaucuuggaggagaauaggcugcuauuagcaucuaguggguaagagcaagggaugcuguagaacuuccuacaaugcacaggcgcauccuacaacagagaauugucuggccccaaaagucaauagugcugaggcugagaaacccugcacuuguguggaccaugcccuuuuaugcuuuucaaccuugaagcacuaauaggucagagaagaaugccagggauguguugaugggucugcaagagguugaugggggaugcuugagcuccuaccaaguggaaggugguguaggcaaagagaaggaugcauaggcacauuggacgguggaaggcaggggcugcugaaugauguggcaggaaacaugcaaagugcucagcgucccugggcggugcagagucuugggaagcaagaggauggagccauccuuucaguuuccagccuggguuucccaaaggagaggguguuugaguucaguggcagagagaguggggaagaguguuggagcccagcugaguggccaccuuugucaaauggagcugagaaaugauuuucacauggcuggcguaauggcggaguuuccaaaacagcagcacaacaaaauagccauuuacaugucaagacuauauucauagaauccauaugucuaagguggggaaguugucauuauuccuguuuuauagaugaggaaacagaggcccagauggaguaagugacugcugaaguacacaugauuugucaguagaaaggaagagaccaaagguggcaucaacuuuaucuuuccuucuuuuuuuugagacuggagucuugcucuguugcccaggcaggaaugcaguggggugaucucagcucauugcaagcuccgucuccuggguucacaccauuuuccugccucagccucccaaguagcugggacuacaggcacccgccaccaagcccagcuaauuuuuuguaauuuuaguagagaugggguuucaccacguuagccaggauggucucuaucuccugaccucgugauccgccugccucggccucccaaagugcugggauuacaggugugagccaccacguccggccuguuuuuccuucuuuguuaaguggaacaagucauuuuuuugguggucauuuccaauauguaauuccugauaacacacguauauauuaucucuuuaaaaauuaaaaaaaaaaaagccagccaaaaaaagaaaauggaaguguucaagaaacugccuuuuuucauguaauaguauuucugugucacuaaauccuucaacagcauuauuuuuaauagcugcccaauguccuaauggaugggugagucaugauuuacuuaaccaauccccuguuguuggacauacagguuauucacagcuuuucucuauuguaaguggaauugcaaugaauguuuuuguaguacacaccagugagugauuccuuggugcgcuuggaagugcugguuccaagaauaagauaaggcuuugagauuaauugccaaauugcuuucuugaaauauugaggcuacuauuuuccaguaucuucacuaggaauaaguaacguuuuucuaaagcugaguaguaagagaaagguagaaucuaauuuuacugugcauuuucuugauuauuagugaagcuaaacauuauuuuuuauugauguguuaacaauuucuuucuuuugcaaaugaucuauuaauguucugugacugauuucuaucuuggugucuuuacguuugugaaugguaagaauuuuuauguguucaggaacuauuuaaauguucaagacauuaaccugugguuauguauaucacagguacagucacaucgcuuaacaagggagauacauucugaaaaauguauugucggaauucugucauugcaugaagaucauagaguguauuuacacgagccuagauggauagccuacuacacauccaggcuauaugguauagccucuuccuccagggcuaugaaccuguauaguauauuacuguaaugaauaguguaagcaguuguaauacaaugggacauauuugugcaucuaaacacaccuaaacauagaaaagguacagugaaaauaugguauuauaaucugaugggaucggcauuguguacauaguucguuauugacugaaauguugguaugagguguaugacuauguuuucucaugaccucugcuuuuuuugucuuuaaguuuuuaauuuuuguuuuacuuuugucuuuuaauuuuaauucuauugcaaccaaaucuaucagccugucuucuaugaucucugcuuuuaauuguuacgcuuuaaaaauccuucuccaugguaacauuauauugacucauaugucuuacugguugaacgugccuauguuugacuuugaaaucauuaaauucauugaggauuuguuuugccaugaggaauuggguaaggauccagcugauuuucuccagaugaguaguucauugucccaacaccaguuauugcaauaaguuauuccuuccccaggaaauauaccugggcuaauuaagaaaacugugcuucaauguaauuauuccaccuuaaugcaugaaauauuagguuaacauggaaaaaacauggcaucccauguuuuaguauuuuuuccuuauuuccaagcagcaccucucuuugaauuauauucuguucucuguuuuuauaauuugacucccuucuauucuacaucuaaauagugcauugucuguuuucacucaggacuuuaaaaauaguucuaguacuaauuguauuuuuauucuaauacugcuauuccuuuuacugguacuucugcaucuuaaaaaaacaaaacaaaacaacgaaaacuuggcauguuggcucacuuggugaaugaaagcauauacuguucaguuguuuauucuucagcaacaucugaguauccucgagaaaugaguggaaugaaccgcuagagaugaauagccuuaagcccucaaagcugagcccuuugggguaacuugcucuaauucugcccucuccaguuugaguuuagguuaaauucagcuugcagauugcaccaagccugaugccucccagccaucaaggaaaaggguaccuaacauuuugaaucuccauuaaucuuacagcucagauccuguguauuaaaucucagcauuuucagggauguauacucuggcagaaaaacuuuaaugauuuuuuuuuucugaugcugccuagaaaauauuagaaagaagacccuucuuuccuuuccuuucuuguccuguccuguccuguccuguccugucuucccucccucccucccucccucccuuccuuccuuccuucucuccuucuccuccuccuccucuccuuuucuuuucuuuuccuuuccuucuucuuccuuucuuccuuuauuucuuucuuccuguauuauuuucuuguauagcucaggucucacugcuuugcugccauucuuguggagaauaauagguaacagaggugugcaccuggccucauuuauugucacacuggauagguaauagacgccggcauggcuaugcugugguuccugcugaugggcacacuauuacaggugcaugauaagugugucguacgcaggaaguacguuucccccagccuucccuaccugcugagggcugcucccagccuaaggauuucauccagauagauucauagcgcuuccaguaaaugcaccccuugccuuucaaaguugaaaaagaaauuacuuuggacacaaagagguguuucuuuugacacagcaggcaugugaaaaaauaagcaaaaaaacaagagggauuucuguuaccauuggcaugugcuucucuuuuacuucuuuaguucacaaugccagugguucagcuucccguucugauccucacugcucuaaucucuucaucugugcuugcaaucacagccacgcgggcucgcaauauuaccacgaaaucauuuuaucuguuggaaucucuuuccuguucauuacucuuuuuuauccccagguagacaaacacccuaaguuuaccucuugcgaauuguacgcuuuaagguuaaggaauucguaguugaauaagaaugacuuuucacauaaauuuaauggaguuuuaucuucugagccaaggcuuuauuuaaggagucuugggagguaaucauguguuaccugagacucuccgcccauaggauguaguuccuuuccauuggaacacauggggaccgagggaauaaagaauguuuucaucucugaaaauaucucucauucuuccaaucaaugcugcucuuuucuugcauacuguauacugggaagcauuuguuucgauuugugguuaaauguauguguccacuggacuucaguauccacccuuugaaggaccgcaggagaaguuguucagguagaaacauacaagggccggaugcgguggcucacaccuguaaucccagcacuuugggaggccuaggcggguggaucacuugaggccuggaguuugagaccagccuggcuaacauggugaaacccugucucuacuaaaaauacaaaaauuagccaggugcgguggcgcaaaccuguaaucccagcuacuugggaggcugaggcaggagaaucgcuugaacucgggaggcggagguugcagugagucgagucgugucagugcacuccagccugggugacagagcgaaacucugucucaaaaaacaaacaaaaagaaacauaccgggagaucugguucuauugaaccccagugcagccauggguagaauuuuaggcuuauuuauauuccauuucaccacaagaugucaccagggcaccacaccaacauggucuauggacccucucucuggcaaauagaguuauggucaucaaacagcaccugcccagggcuauggggagaggaagcugguuggcuuugucacaaaugccuugaugucucuuuccuccccuggggcccaucucuuccagccuuugcauagagagagaaggcaggcaacaggacacaagaagauuuucccagaguccaggguguucucuuaccccugaaaucguuucuucacuggaugggaaggcaggcacccagggggagauggcaucagcugcauaaacaauuuuucuccucaguagacauuuacaugagucaauaggaaucauauucucucuuuuuuuuuuuuuuuuuuuuuggagauggucucacucuguuacccaggcuggaaugcaguggugugaucucagcucacugcagccuugaccuccuggguucaagagauccucccaccucagccuccugagcagcugggaccacaggugcuugccaccaugcccaacuaacuuuuguauuuuuuguagagacaggguuucaccacauugcccaggcaggucucaaacucccgggcucaagcgauccucccaccuuggccucccaaagugcugggauuacaggugugagccacuguaucuggccuaggaaucauauucucuucacugaaacauuucagaugacuuaaaaauucaccuuguagaacuuuuaaaauugaaacuuucuggugaacaucauuaguugacagauaugucauugaaguuucauccuucuucauuucagagucugcuggaagacccuucauuuaccacucucuccuuccuggagguguggaaauacucuaccugggugaggcucucguggcuuuuugugccaaguguccguaaacuucaacuuaauuguuuuaaauccuuuguggugauuaugcggaaggucaaaucuaacaggaagcuccauguccacuugauguguacuuacuucuauuuuugcaccuuguguuguuuguuauccugaauuaugccagggcugguuugugcuaagauacuuguuauuugaccucauaauaccagcaugucccguuuguauaacccucucuguagcuucuuccagcaugugaucauacaucuaccuaaccucucccauugguugaauuuaauauacuagugaauuuuccauugcaaagaugagguuacgaaucauaguguucauacucagaaggacuuuauaaauauuuugccuuuuugaaguauauacaagaaaugaaaaaaaaaacaggaauaaauaaaaagaauaaaaagagccaggacuagaaccuacaauuccugacucuugaucaaauugcuuuucuuuuuaacucuaguuaaauauuuuccauucuuuuuaacucaagaagccuuuguuuuuguugucaucguuuuaugauuaacuuauaucugguccuuuagacauuuagauuuuuucuguuuuaucucucucuauauguauaucuguauauauauuuaucuauaucuauauagagauauauauauauauauaaaauaaugaaugaaauggacuguuugcaaccucagauguauuucuaggacuuagagugauuagcuugaggcgaugguaguuucuguuuuuggagucucuguaggucucagacucacagucuguacuucuuguuuugggggcuaauuaaguggacaguuucaguguugguagcucauuuaagccauaaacaugcagaccauguggaaucccauuagucaaaccuuagcagagugccuugaugaguaccuccuuuucuuucugaauucuauuaguugaugcuuuguucuuucuccccaagagccauaucucagcuauuucuuuucauuucuuguguauaguucaacaucuuucuuucuuuuuuuuucuaaacaggaucucacucugucacccaggcuggagugcaguggcaugaccauggcucacugcagccucgaccucuggggcucaagcgauccuucugcaacagccucccuaguagcugggacuacaggugcaugccaccacacccagcuaauuuuuauauuuuuuguggagaugggguuuuaccauguugccuaggcuggucucgaucuccugggcucuagcaauccucccaccucggccucccaaaguguugggauuacaggcgugagcuaccgugcccgugcccggccuuacguuucagcaucuuucaauccaucuaauacgcagugccagggaagguuugugaaaacauuugaaucacagagucacaaacagugagaauagcugcaguuauguuugugaugcucuaaugaacuuacaaaaggccaggccuaguauuucagcuguguccaugaugucucugauggaaauggacagguaacaugauguacacaagcauuugacuguugcauccuuugauugggccauguucaugcagccagccugggaaagcaauuaguaguuuuaagcaugggaaaucauauaaaaguaaacuaaaauugcauuugaauuaauugaugaacauguuugcuugaccauauccugcuguuaggcgucuucaaguuaacuuaagugguugauaaaacuuuccaaaaagaauacuaucaacugcugagcaccuguugucagaguuguggguaauucgcaaagguuuucaaauggaaaaguuguuuucuccugcuaggaagcauggucucagauccacuucuaaggucagugugaaagggaaggcaaauucacuuugagcaggggaggcaugaucuggaagauaaagcagcuaggaguauagacuagggggcugauggaggggaacaccuaucacaauauguguucucacaccaaugguauauauuuuccacacauuuagauucuccaugccacuccuuaucucuuuagugcagaaaacggagaggagguucaguauucuuaagaaacucccaugauugcuuugaggcaauggauuuaacagguaucuuuaucccuuauuuacgcacugacugugguacugagucaucccugguguuucuggauuuuauuggcaaugccaagagagcaggaagacugggacgugaacugacaacauuuaugauucuggcagcuugacaucacccaacuguucucuuuguuugguuuugcuucagacuuaguuuaguuuuguuuuuuaagggcugggguggaggagagggauuugcucuugcaguuuuccuuucaaaccaaacucuuucaaagccuuuugcaaacucuuuuauggauuuuacucacugguugagcaagaguuacuuaugagauguggcuucggcauuuucacaguguccauaaaaaaauguauauuacuaugcauugcacauuugccacuuagaauuucugaaugcaaauuaaucaacuugcagcugugacuaacaauaaaacacaggauaauguaccuacagaaaugagggcauuggaaauccgcucucagguggccaucgaaaauagucagccugaguguugcuaccuguuuuccauaauuguguagcuuugccuuuccuuaguuaaucuguucaauaaacuccucugcagaauccaaaugcuuaaauucaguuucuuuuugucuuuaugguguuuuucauuguuaacguggcaucggaguagcucgacuuuugcaucaugauaaauucauaacccaagagaaggcagaaaacauaauuauuaucaauugccucucuccuggaauugccauuggcugaguggaacaaaauacgaacuuaaggaguagcugauucagagaaauccaggguaggaacgggucccaucuugauuucaaugucuuuuuugaggaggccuucccauugcacuucucuucaaguuugcccagauaguaaguucuacuagacaugucaauuuuuucugaggucuaaucuugauuuuuuuuuuccugcacaauauggaauucaguguuuuuauuuaaucauucaguaagucuugacugccugcuauggagguuaagcccuuuacuaaguuccaaggauguaccugugaauaaggcaaguuccuuuuuaucauugucuuugcagucuauuaggggcuacacaauuuaaacagagaauauauauaaaaugguagaaaguacaaguaaguauaccuuauuuuuuuuaaaaaaaugaaugugguauuucacccacagccucaagaaucacuuuccuuaaaauugccagaguaggaaaacuuacaauugaagaauuucagguauuuaugggaaaaauaguauuagggcaauugcggucaaacacauucgucuguucguucaauuacagcaguaaggauggaagucuaaagagaguuucuacgugaucuuauuuauccugcauuuauaaauacacaaauucuuguacaauuaacucaguuuuucacuccuuucuugcuugcaacuugucaggucguucccuccccaguaguugugaacuucuuuaugcuagcuucuuccaucaggggcucacaaccagggacuguagagguuugcagagguaaaucuugguagauaaggauuuuaugaaaagggagcucacuguuggugaaaaauccuuguuucuacagauuuugggucaagauaagaaaaauuaacuuuuaaaaucugaggaauuuggagauuaucuccaggggcugaauauauuuuuaugggagaaauaaaauggauaguuuuaaacuugaauuuaguuuuuccuaauggaggcccuuuugaagaucaaaugggaucuguaaaaacucuuugaaaaauguagacugcuucuuaugugauucuuacuggucuauuauuuaucaagaaauuaaaaaggaaugaauaucuguagcuguuuuucuuuuucuuucuuuucuuuucuuuuuuuuuaagauggagucucgcucugucaccgggcuggagugcaguggugcuauuucggcuaacugcaaucucugccuccuggguucaagcaauucuccugccucagccucccaaguugcugggacuacaggcgugcgccaccaugcccagcuaauuuguaauuguuuguuucuaaaaggauauucagugcuuccacugucuuuuagaagucuguagaaggaaggccaagaaagaaauacccauuauuuuggcugaagaugaucacuuuagcugaaaccaguucagguucaaacucagacauuggugcuauuuucauauaucugaaauguucugaaaagauuacugacgaucaacaugcugaacugacauuucacagauaugcagauuuauucaucucuguucaagguaugccuuuuccaaucauaauagccacguagaggacauuaaacaaauauuuuauugugguaaaaacacuuaacaugagaccuacccuuuuaacaaauuuuuaaauauauaauuuauuauuauuguugacuauagguaaaacaggacauuuuuaacgugcugugguggccuauuggacuuucagccucccuggguguauuucgcuguauauguguaccaugucagcuuacccuagaauuugaaacauuuuccuuugaugauuaaauuuuuuuuuuuuuuuuuuuugagauggagucuugcucuuuugcccaggcuggagugcacuaucgcgaucucggcucauugcaagcuccgccucccggguucaugccauucuucugccucagccucccgaguagcugggacuacaggcgccugccacuacaccuggcuaauuuuuuuguaguuuuaguagggaugggguuucaccguguuagccaggauggucuagaucuccugaccuggugauccgccugucuuggccucccaaagugcuaggauuacaggcgugagccaccgugccuggccugaugauucaguuuuuaccccaagaugcaguaugccucagucucacuaaaauaugccaauauguucuucuucuugaggaucagggcugauuucuucuacugggaaaauguauccccuguguuuggccccagaggcaucaggguaaccugcucucuuccauucucaaagcagaaacaguguuccuaacauucuaagccugggaauaggauggcaggucgugggaccagcauuuuaauuaccuaaagggaacuuauugauuuuaguccagaacacgguggggaggaguucauauucuuuuuuuuuuuugagucuggauuuuagaauaaauucacuguguacauagcuauuccaucuuuaaaaaccuuugugaauguuaauauacagccuuuauaaauuugagguauaauguucaaaaugcucuaaucccuaaauuuuccagucuagguuauuauacuuuuaugacuauucauuuugauguaggccuuuuaaaaucaauuccucccuguuauuacaaugcugcuuuaugguauuugugauauaucauaugaauauacuugagggucaugagaaguucauauguguguguguagugugggccccagacuuucgccauaccgcuggcuaaaguggccauguuuuuguacgucucugcagagcuuacaaguuauucaacagccagauuucuauucugauaugcccuuuuaguuuucaaagcaucgaaaaaggguaaucuuuagaaccgaaguauuuggaaaacuccuagacuugaauaagguauuuuugaauuugaagagcuaagaacccaucaaaucaaaaugcuaauaauucuuccaagucaaaagguaacucucauuuuauuaugcauugaccaccauucacuuucuguuggacugcuuuuggaaaaagaaccacaagucucuauuuuuaaaauagagguacaaugauaaaacaaaacaaaacaaaacaaaaaaacaacaaaaaaaaacccacacaggucucaucagccaagggauuuaaaaaucaaauuuaacuucaaaaaacugaaguugauauagcaggaucuuggagaugcaguuucuucacuuuucuuuuuuuucuaacugagggauuaaggauauaaacccaacuucaaauuucuuucuggguggucuugaaaacuuaacaguagguccuguaaagaggugggggagaggaaaaagaaauccuuuacucucaucugcugguuuuaaaaugagaaaaauacacacacacacguaaugauguucgugauguuaauggagggaaauaucauaaauaauuaagaauuuaaaauuauuauaaaauauuuaguauuauuguuguuacuguuauuaguaggaaggggccuugccaugcuuccuuucuucaaacagcucaguacuuuaaaaucgaguguggcuguguuugucagucgugguuuguguucuuugauuuguucugcauguucuucuuuuggagaggaugugucacuuugccaaucuugguccuugcuguugucugguggagggaaacaagccugccaggccggcucaucugaccccugguggcagggaguggaggugcacucaggaugcucuuggggaaucauaaaggagguuaaagaaagggacagcagaacccugacaauccuugccccuaagcauggaaaagccuccggaccgggucuggagugcaacagaggccccugaccuugucucuagcucucugucugcaucuucagcguggcuucacugguuucuaagucucuggugucuuuugucuuuugcagccggcuugcaauugccuccuucuaacucucaaaaggaugcaugggauggguucaguguagucacuguugugccuuuuggacaaggcuuuccagccaggccacccuguuuacaaggcuguccucacgucaugggcgcucauauuguccagacuagauggucaaggugauugggggaaggaagucacagagccaccaauuacuaaggaacugcccagagauccugccucacugggaaccugugagugggcugguuucccccagcagaggggcuguagcauagcagguacccacaggagccugggcauggccuuuuucucuaaagggcuggauagucaauauuuuuagcuuugugggcuuuauggucucuguugcaacuucucaacucuccuguuacagcaggaaagcagccacagauaauauauaaauggacggauguguuccaauaaaacuuuauuuauaggaacaggcagugggccagauucagcccgugggccauagguugccagccucugacucugguguucagaucacagacuuuggaugucucauaucugaaucuuucuaaucucgugauagggcaagguaauuaaaauguuaauacguuaguuuucucacugucaauguguucuaugacaucauuuaugcaaagcauacaaagcugagaauaaagucucagcaaaugcuaguuuccuggccuccuuauacauacuuacaaaggauggugggagauaguuugagauuugaggccucugaagaauagguguuuuugugaugauuuuggcuuuucaguuugacaguuggcuuugcuuuuuugacagacacauuaagagcuucaagggucauuucaugguuuguccuuuccaugucagggacaccuuucacguggccauuuuaagcacaggaauugccuucaaguaguuuacucguacgaacuugucuguaaucaucuuuccccauuuggaugguggguugcccauuuuaauucaagguuugucuaauguguuagugcauauucuuggcucaagcaggauaagacacuaguaaccaugaaccuguauaucaaaaagcgugacuagaguuucauaguuaaacaugugcugaaauccacaguggacaccagagagggucauggaaucugggaauggaugacuugucccaugaugauaauaucuguguuccuacggcugggcccgguggcucacaccuguaaucccagcacuuugggaggccgagaugggaggaucacgaggucaggaguugaagaccaccuugaucaauauggugaaacccuaucucuacuaaaaauacaaaaguuagccggugugguggugcaugccuguaaucccagcuacucaggaggcugaggcaggagaaucacuugaacccaggaggcggagguugcagugagccgagaucacgccauugcacuccagccugggugacagagugagacuccgucucaaaaaaaaaaaaaaaaaaaaaaaucuguguucuugccuggcuuauugagcuccaugguaaauguucagaggcugcaggaaugauucaaagucugacugauuuaugugcauugggcauuuuguugaugucauucagauuaaugauggcacugaaaauguguaauggaaaugagaaguuuguauccugccugcuauaccaugauuccaauuuaagaggggguaaaaauauugcacuuuuuaaucuauuguuuuuugaaagagacuguuuaaaacacguaauuuugcuaaguuauggcucauaucguauuuguuauuuugguuuugaaaaauugaguaggaagcaauugcguucuuaaaugacuugaacaucaaaggcaaguagugucuuguuuuaggagcagccaggcuccuaucccucugauccagccaagugcuuucacuuggucccacucuggggaaucaccagugguucucacucugggagaggccccugguugaccuggaaugaccuagaccagcagucacaagcuccugcccauggacaaaauacagccgguaccucuuuggcuauggccugcaggcucagaauaguucuuacauuuucaaucaucugcaaaaaagaauaaagaggagaauauuauuucuugaaggaggaaaaugauauggaauucugauuucagugucauaaaguuuugaauuucaucaauaaaaaauuugcagaaauuuguuuuucucuccuguuauguaaauaccucuguaauagccucgguuuugccucuuggcucacaaagccuaaguuguuuacuauuuagcccuuuacaaaaaaaguuugccagcaucugauguccaacaacaauuuucagucuuuuuuguagcucccaaauucucucauuaaaccagaucccuugagggaagccugguuuacaaaauagauuaagugauguggcuguuuggagcaggaggcuguggucugagucuugcuggccucaacccucaacucacuuccacaccuuaccuccuggggauaaggcugccuucgucuagaaagugccucgguuccagcuuggaaauauccauguacagucccuuuuuuguuauuccaaaacccaaagagaucugaaaagcaaaaacaaauuuauuguauauuuauagcaaauuuauuugguggugaaauuugacuucagcuuuagcgucccuguuucuccuuucuagugugaauguucauuuuguuuuguuuguuuuuuugaggcaaggucucacuucaucacccaggcuggagugcaguaguguguucacagcucagagaagccucgaccucccgggcucaggcgaucuuccugcuguagccucccaaguagcugggacuccaggcaugugccaccauacccagccaauuuuugugucuuuguagagaugcgguuucucuaccauguuggccaggcugaauaaucauauuuucacugaagaaauagaaaugucauuguuauaggauguugccccaaaccccgcaaagguauuuuguaauaugcaguauaugugcuaaauuacuuuuuuuguuguuguugagauggaguuucgcucuuguugcccaggcuggagugcaguggugugaucuuggcucgccaugaucucuaccucccagguucaagcgauucuccugccgcagccucccgaguagcugggauuacagacaugugccaccacacccggcuaauuuuguauuuuuaguagagauggggcuucuccauuuuggucaggcuggucucgaacuccggaccucaggugaucugcccaccuuggccucccaaagugcugggauuacaguaccuggcccaaaauaccuuucuaacauggaggaauuaggaauacugaaggcaucggcccccaaggguuugaugugcucuuguccccaaggccugcagauuugcaucaccucuccacuucguggacuccucguaccugccugauuccaggaugcucuaaccuggccacgcaucccccguggauucucagcuguuguguguuuccuccucagguggccacugugucuggugcucacccacauuuugguucauccugacuuugccucagccuccccauucugcauuucucccacggcuucucccagcccuggcccagugacacuguaauguggacuguggcauccccugagucuaagcuguugaccagcucuugauggacagaugcuggcagagauggggaaggugcuguucccuuccuccugggaagggcaaagaaagcagggugguccucccauccccgugaggaaggaagagccucauucaugcugagacccugauggagaacuggguccagggauaauguuuuguguuccugcucaugggacugguguguuauugucaagggaucuuacaggccuugcuucccaggccccucuauccccucuguucuugcuuaggcauuagugauuugguucuucuagcuuuuuuucuuuuuuugagacagggucucgcuuugucauacaggcuggagugcagcagcgcgaucuuggcucacugcaaccuccgccuccuggguucaagcaauucuccugucucagucuccugaguaggugggucuacagucacaugccaccacgucuggcuaguuuuuguauuuuuuaguagagauaggguuucacuuguuggccaggcuggucucgaacuccugaccucaggugauccgccagucucaaccucccaaaaugccgggauuauagaugugagccaccacaccaggcuggcucuucuaguuuuugaagcucacuuuucuuuuuuccucaagacucacagggaaugggaccaggcaccugucuuuauacauucucaaaguccauggugacgaugccaugcuccgguucuaagccaguuggacagacacaggcaagggaagcugucagugugggugugaguugcaguguaaggguaguggguggaauagcgucuccccaaaauccacacccacacagaaucacagauguaacguuauauggaaacagggucuuugcagauguaauuagcuaagaaucucaagguuaaaucauucaggcuuuagagugggcccuaaauccaaugacgguuauccucaugagaagaggaaagcagggggcacaguggugggugugccugcaaucccagcuacucgggaggcugcggagggggcaucacuugagcccaggaguucauugccagccugggcaauauagcaagaccccaucucuuaaaaaaaaaauaacaccaaaagacaaaacagaaaaaggaggagaggacacagaggagaaggcucugugaagucagaggcagagauuggagugaugcgucuacaagccaagagaugccacggucaugggcagcccccagaaacgaggagagaaaccuggcacgguuuccacaaggagucaccccugccaacaccuugguuucagacuucuggucuccugaacugugagagucaguuucuguugagcuugugcugauacgcuagggcagcccuagcacacugccacaucugguuucccggaggaacuucacagggucuuuguucuuuaucuacagucucuggaagucucagcagccuccuguguucgcaacugucauuccagagcagccgucucguguuaugcauuugcuuacucauaagcaaauauuucacaagaaccugcgagggccaggcugggccaggcagguauugcaggugcaaggaucuauauaagacagugcccuuuagaagaucccugucucauugagaagcguugaguaaaugggucucucuggucauucucuccagaacaugaagccaaagggcugagagggagagacuccaagaaugaauuaguguccagcaagguaucgcuugucucaggaugacaacuugcaauuuggggaucucucaacguccugaccuccaucucagugggcauguuccucaccuggcuggcugccccugcuuacugaugcagccuccugucacacgguacucaccucuauucacuguauuccaccaacacuggccuugggagccagcaguacccccauuguacagaugaaagucuugugacugucaacauuaaaaugagaaugauauugacccaugauacuuacccaccuguucaguggauucggugugccgucagcaugguucccagcacauaguaagugcuccguaaaugucagcaucuauuauuaucauuuguguuuuuuuuuccccuucucugccuuccuuucucucccuccuuggucugcuuccuccuguugcuaucagagccugccugccucauccuuguuccagccuugauggugaugaugauugugguugcuguugcuauuuguuuuuuugguuuguuuguuuguuuugagagggaguuuuacucuugucacccaggcuggagugcaguggcgccaucucggcucacugcagacucuuccucuugaagcuggggaaguucaagcaauucuccugccuuaggcuccugaguggcugggacuacaggcaugugcuaccaugccuggcuaauucuuuguaguuuuaguagagaugggguuucagcauguuguccaggcuggucuugaacuccucagcucaaaugaucugcccaccucggcuucccaaaguguugggauuacaggcgugaaccaccacgccccucacgcgcagccacuguugcuauugaugauuauuaugacaucauugcucagauucacuuggcucagagagggcggagucagagugacccagguggucacugcuccccuucuuguccaucaaaucagcugccuccaacagcauugccuggcagcgucacguaguagcccucucccucacaaggcuuuugaggcagacaaaugccacugauaaagcaaaagcaaauguuuugggugaauuccccauagcuacacuagauuugaggcugagaaauggaaugccugucauuguugacugaaaaauacagcucuccuaauagagucuuggugcaggagcuguuagccuugccgcccugcagacuugaagaauugcgacgucggccuaacauaauuuugguaacuuugucugcuucugccucggguagaaauaauucagauuucacucuccauuuucuuuaaugggcuaaacagccacuuuguaauaccuguauuuuauuagacauaauucuggauauuguuucugcagcguuuuugaaaagacaaaccugagagagcccagcuauuuaacuuaagcaauuuuaaaguuauuuguaaaaugauaugcugucuuuuuugacccaguuacuuuauaaagcuacauucuuuggcaaacauuaacacaacuucuccgugugugggcuaaauaaauauucgggcaacacugauugagcacugccuuggguaaauaauucucucuccacacauuuccuaguuuauaaugaggaguuuucuucguggucugaccaaauguaacauuccauugaaaaugagacauaaauccuugagugagggagacguggaaccaggguuugaggaggguuauuaaaaaggugaggguagcagggugaccuccugaguccccugcucucccgagccuucucuccucucuggaacccauggcuaauaggggacaggagagagcggaagcagaaagaauaagagauaugaaagccagccgggcacaguggcucacgccuguaauccuagcacuuugggaggccgaggcaggcagaucacuugaggucaggaguucgagaccagccuggccaacauggugaaacccuaucucuacuaaaaauaacaaaauuagcuggguaugguggugugcgccuguaauuccagcuacuugggaggcugaggcaugagaauugcuugaaccugggagguggagguugcagugaacugagaucgcaccacugcacuccagccugggcaacagagggagacugucucaaaaaaaaccaaaaacaaaaaaagagacaugugagccuucccuucccucuccccauccuagccuccucucacccagguccauucuuccacugucaucccaugaugcucucuugcauuuuaaaguuuggaagcccuuauuccuuuguuuuguuuuugaaauacaaauaucaacauuuuuauuguucuauaguaauacacguuucuucuauaguacauuaaaucacaagagguaauaguguaucuacuaacaccuauacuuuugaguaguguugaguguaaaugauauuuugaaauaucugcaguaacugaugugauaugcaaacaucugugauuucuuuuaauuuuuauuaauuuucauuuuuuaaaaaacuuuaguuucugggguacucgugcagggcuguuaaauagguaaaugacaugucauggggguuugguauacagauucuuuugucacccaggucagaagcaugguacccaauaggugcuuuuucgguccucucccuccuuccacccucuacccuccaguaggccccagugucuauuguuuccuucuuuuuuugagacagagucucacucugucuuccaggcuggaaugcaguggcaccaucuuggcucacugcaaccuccaccuccuggguucaagcgauucuugugccucagccuccggaguagcugggacuacaggugugcaccaccaugcccggcuaaguuuuguauuuugcguagaggcaguguuucuccauguuggccaggcuggucacgaacuccugaccucgagugaucugccugccucggccucccaaggugcugagaucacaggcgugagccaccgcaccuggccuauuguucccuucuuuaugugcauguguacucaaugcucaguuuccacuuacaaaugagaacaugugguaguugguuuucucuucccgcauuaauucauuuaagauaaugaagcuccuguccuugacccaaucuccacucuaccguuugauguccaguguggacugccccucugaaagcccuucacugcggcuuagccugugguggaagguguccaagguggcuggaacaccuccugcugggggugucagucuuggcucuccuguuuucugccugugcaaugguggguaggucccuugauaccucguaaccucagcaucccugugggugauaaggagaugauaauagucucuucccgauggggguuaaauaaaauaauucucggaguaugugaagcaguacaugugaagugcucagcuuugugucuggcacauaaggaaguggucaguguuuaauguuagggaucauagaugcugauaaauugccguuuauggcauauuucauguauugccucauuuaaaccuccuugcaaucuguaugacuccugcugaugauggggaauuugagacugugagaggcuuggcaaaagaucuaagcugugaaguaucuggaauaggauuccaccuucagcccugccuuaaugaagaccauggucuugccacauugcaucuccccaagauuuuuaugguucuauuuuuagucacguuggccugcguugguaaauuuaccuuuccugguccuuuugaguaacuaucucuggaaaggauuaagugcagugaucaaucagcagcaaaguccuggaagaaacccauuuguuagucucugggccuccccaggccuuaucagggcuuagccuucgagcaguagcaacacuugcaccugcaguuacuaauuccuguggaaugaaguaggcgggcccgaaauguacagcccuuauccagugaauucucauaggagcaaaaaaaaguguuuucuuucccccuuggaguucuguuucuucuuaaaauuagcuauuucucauacacaauagggacauauucauaaaaaagggaaaauacuccaaaguugaaaaaaagauugaaaaagaaaauccuccaauauauaucuacucuuagcauuuuggcacauauucuuacaguaguuucaaaugcccaggccauuuuguuuuauuuuguuuuguuacaauuguggcauauguacucgugauggauuugcuuguuaucucuaaauuaauucuccuccugcaauucaaauauuccagagauauguauauuuuuaacacauuguuaauuaucccauauggauaauaguuucuuuucucucuuaacauuuuaaaagcaugccuccagguuguucuagacgguccugaacagugcuuugaauggggacauguuaguaaaccaaugagaggaaccacgguuuaguucaucauucuccuucuaacuguauuuuuagguugucacuaacucuuuucagucgucauuuccauggccacgaacaucuuugguucuaaagcauuuuucccauuuaaaauuauuucuaugggauugauuugccagaaguagaauuucuaggucaaagguacaaacgcuugagaaguccugauacauauuaacuugggccagaaaucuaccauguaauugagagcaccuugagcuuggcuucagagccaggaugaggacaggaauaagugggccuuuugauuugaaauguugagauacgaauguauucuagaugggccaaauaaccagcuuauuuuauuuuaaagucgagugaauuuucugccucacuaaugugcaugucuucaaagacaaguagugggaacggaguggggauuugucaucccauagaaugccaccacauggaaucgguccugaggcuucugaaagcaguuccaaauuugaauguuuccuaaguuaguucuugcgguacagcgcagacaauauucuuccucgacaauagcugagacccaagugccugggcgcuuccaggucauaauuaaccucuucaaaauaagagcaaagaaaggcaggaaaagguccucuccauuccagaaaggagaacaaagagggggaauucuaacccucuugccaccucuguucucguccguuccauauuaagaagcauucaaagacuaggaugccauuuugcaaacgucucauucucccugaaugguaaggcuccacgcuuuagcacaagugguacaaaucugccuucccucauucuuuuuugcagaucaucccgcuccccaccccuuucuuuaucauggcucauuuggagcaucugugcauuuuuuaaaggcuggauuuucuuucuguugccauugaaacauugcauuuguacaggagaacuacuuaauggcacaguuuguuauuacauggaauuaaauacaaccuauuuaaaucauguaccgugaaaccaaagagcuguguauggaaaaagccucauauaacccaguuugccagguccuaacucccuucauacauauacuaacaugcaaaagaccuccuaccuuuuuuuuccccuucuguuucucucuugguauaacacuacccuguuuuugaaaguacuuguacugcuaauauauucuuuaaagaagaggggggaaaccuguugguccccucauaaaacaguuaacaggaagcccaaggcaucuuucagugccauuuuuggcugauguuuggaaugguuccaucaaucacugcuguucauguauagcugguuuuuaugucaguuaaaccaucuuccaucaaguuggugaagcagagucagggaacaagaugaauagcaaaacgucuucuguggcauggaaaaggcuuugcuuuuaaaugcccguguugauuucuuaauauuuucaacuuccucuucugaagccaguuccccccgaccaucagucaugaguccguucuuuuaaccuuguucagguggcguggggcgguguguuugguggggagugaugggugcuugccuggaagugcgagcaauugaucagcugaugagggguauuuauuaucugucccugacucccgagagaggaaauaaauccuuggaccccagagugauuuucggagccacaagaaugcaagauguccuguuuccagucagaccauagcaguaucagucugugcaguuggaaucuugcauggggagguguuuuuauuucacacaagaaagaauggcacaucuuuccuugaaagauguauuuuguauaucuuaaugucaguuauguuuacguguuugcugcucagaaaucaacaggauuucugcccuuccccagcccccuuuuuuucagcccuucagagaauauuuguugagugcaguguguaaaaucauggcggugccaagagggggugugauggguguggccgccccccugccagcaggaggaaucuguuuucacugacauuguuuggaaucaccaagcauggugaugauaaaaagcaguuaaacuuuggucacuuuuauuaauacuuuuaaguccuuagcgaacaaugcacccguuauuacuugcaccuaguggacaugguucucauugcugcugcccaccuuucuuuuuuuugccaugggugcaaaagaugccucuggggaucccagaggacucagcauugguaaggaugcaguccuaauccugaaggaggguacagcugaccagggagguaacacaugaaugcagcugauagggccaguuggacccagauuucaacugcaaucucuauuuccuucggaucuguugcaucugcucaaacacuaguucugcaauuucccaacaccugcccccugccccuuauaaaagcucaugguuccaugugacuuuccacuccugcgucucuggccuuggggcaggucaguccguggaucaccucacuguccuagggaugcucuucugguccacacugugccuaccuuggauauggaguuccacuuguucccuuaccuuucacccaccugugcuccucacccaagcaggcauugauggaggucucauacuuuacugaagaugugaggaaagaggacacuuauguagaacccaacugcagguggagccuuggcgauccauagcccucuguaaaguggggauugaagcacauaucuugcaaggcuugggcauugauugcagggaguaauguguauaugaaucaucagcuaugcaacauaaugcugaugcuaaguacuaacauugauggaguguuggcaugagcugggcagagugcuccauccucuauguguguauuaguucauucuugcacugcuauaaagaaauaccugagacuggguaauuuauuuaaaagacaccuuuaauuggcucacaguuccacaggcuguacaggaagcaugaugcuagcaucugcuuggcuucuggggaggccucaggaaacuuacaaucaugguggaaggcaaaggggaaggaaagcaucucacauggugcaaacaggagcaagagagggagcaagggggcaggugcaaaacacuuuucaacaaccagaucucaggagagccaacucaccacacagcauacgugcuaaaccaugcaugagaaaucuguccgcaugaucuaaucaccuuccaccaggccccaccuccaacguuagggauuacauuuggacaugaaggcugggugcgguggcacacucuguaaucccagcacuuugggaggccgaggcagguggauugcuugagcucagucguuugagaccauccugcacaauacggugaaaacucaucucuacuaaaauacaaaaauguagccaggcguggcggcacauaccuguagucacagcuacucaggaggcugaggcaggagaauugcuugaacccgggagguggagguugcagugaggugagaucgcaccacuguacuccagccuguguaacagagcgagaccccauuucaaaaaauaaauaaauaaauuugacacgaaauuugguggggacacagauucaaaccauaucaaugugaauuaaaugacaucauucaguccucaggacaacccucugaggaaguacuuaugccccccggccuuuuuuuuuuuuuuuuuuuuugaggcagagucuugcuccaucaccaggcuggcacgaucuuggcucacugcaagcuucaccuccugggcucaggugauucuccugccucagccuccggagcagcugggacuacaggcacgugccaccaugcccagcuaauuuuuuuguacuuuuaguagagauggaguuucaccaggccagacuggucuugaucuccugaccuugugauccucccaccucgaccucccaaagugcugagauuacaggcgugagccaccgugucuggcgucaugccccguuuuauagaugacaaggcauggaaugguuaaaugucuuucccaagcucauggagugguggcgguggagguguugugaaugugaacccaggaaguccgccuccagagcugcaggcauuaaugcaaagcugcacugccucacgaggucgcugaugcacucucauuccuuuuccuccagggacuccugcacuuugccaggcgugggccagaaugccacucguauuguuuaucuuaaugcuuagugauaguagcuaccuccagugcacgccgcauuagccucuccaaugaguuucuccuuuauuuuaaauguaaaucuagaguucccuuaauccccuuaauuuuuaguacguggcucugagggcagaaacauuuucaggagcagccugggcugaguuuuuaauguggcagcagccucggcugguuucagcaugcaggugagaaggccguucaucuggaacuugggcuacccaacagugcaaguggggagaucagagcauggaaaauguuuuuguauaaacuuagguggaccaaaaugaucauuucaacaacauuucggacuugauuuuuuguauuuauauggccccuuucuucccaagaauugaaagccucaaacuagaacguggcuuuugaacggugaacauuccacaaacauuuaauacagagauggcuguggggugggggcugggggcugggggccuggaaggggagaaggggcaccagaaggagaaaugggaggaaagggcgagugagauagcaaagagaacucagaaaguaauaaagcccugcaguaaucagagggcugaggccagguccccagugagcggcugaacacacagugauucaaacccacuccagaccuguguucuuaaucauuaccuucaccuggagggacagaccuggccuugggcaagccacccccacucccuggcucugugaccuuggcagcugacuggcccucuccaagaucaguuuccucauuuguguaacaguaguaaucuccaauuuagggggcuguauggauauuaaaugagaaaacacacacagaucauuucuuuagcacaacgucuaucuggcacauuagcgagagcuccggaaauacccaugccagggucacaagcucgguucuggagcuggauggccgggguuugauucuuaacucugcuccuuucuagcuguguaacuuuaggcaaauaauguaaccuccaucugccuuuguuuuuuccucuguaauagaaggaacaacaacgaacaacauuuuuuuuuuggcaagauuaagugagaucuuccauuugacaugccuggcuaauuggcagugcccaacagauagaaacuauugguauuguaaggacugcuuauuggguacauaugcugugccaugggagguggaggugcugucaugcugaaccccuauuaaccucaauaggaaaggcaccagguucaagagcugaagaagacacucagagccaacagauagacaugggguuuuauuaggagguuacauauaggggagagaguccagugauggcgggcuggauaguacaacugcccaccuuacauacagaaaugguccaguggcaguaggcuggacaggauauccaccucccuacaguccagugguggcggugggcugggcaggaaaaccauaaccaccugcaaaugucaugugguuuauaucacaccuucacuuaacacccucccccuaacaaccucuaccuggcaaucuucauuuaacuccaaacucaggaccucaauccccuguuuggccuguguuccacgggacaggcauggggcacagaugucuguuauauauaagggacaaaucucuggguuggucacuccuggauuccccagcccggaccacacauucaggugcaucucccacacaggaucauucuaaggguaugcuuacguuaccgcuauugggguguguucacccugcaggugcagagauggcaaccgaggcagcugaggaucagggaguggaauaacuugccuaguucuggcucuucccaucuaauguggcugcacuagaugcuguuaggaggaggaggaagccuacuuuuguuuuuuacccaguuucuguucaaaggucguauuucauggugccucaucacaguauguucuuauaugcccuggcaaacagaaggugcucaauaaaugcuaguucaucuggucccuuaaugaauacucuggcuucgucaucuucccuaggcuuugguuaauuuggugcccucuuuugccauuucugcaacccuuauucauugcugucaacugcucguuacacagcauugccuguuucacucuguacaggugccaggcgucucucagcuucuccucucuuucccauccaacugagcagcaccaauaaauagauaagaaaccugaaggucuacaucaaaucagcuucuauugcugcaaaacucuucuagcuaacuucauucuaaaagcugucugaaauauauuuacuuacacccgagaagauucaaaaacauuaccgcugaaccccgaugcuuugggaacacaugguguccuuggccacuuccuugcuuguuaccuuguccaacagcugauuggcauaguacagauguagacaucaaguaauucuaucguuaaaggauuagucagccucucccuacuccccacccacuuaucucaguaagguuuagucaagaaguuggaaauuaauggggaaggaagguuuuggguuauguguggauuucauuuauccaugcuaucucuucccuccauuagcaugguuaauuaagaguugucaauacaucuuuguuggaguauuugauuauuuuuucaacagggaagauuagaaugaagucuucagaucuggcaagugucaugggacuuguaaaguaaauugcagguuaagcccucauuuugaucucugggaugagagcaagcaccguuucauugacaugucaucagcuaugaucugagggagcacacagaggugcccuuuggggaaagaggggcaucuugcacuugucucccacauugaaaggguuuauugcacagugagugugugcaagugaacaaauagcagauggguuagaauggacagaagcuagcucugagcaccuccugauuuaugcuuuauuuaaaaaaaaucauauguauguauaugugcauacacauacauuguuuuguauauauuugucagauggagguguguguaaacaaauaacagaaaugaguuaaaauugacaaguuagcuugguaaacaucuugauuuauaauuuauuaaaaacuacguggguauguauauacauacagacacacacacuucuucaccaccugaacaaaaaucccuuuugaaucauccuucuugccuuccaaacaaguacacuagcaaacacuuuucccagauggcaaaugacuaugcccguuaggcauuucuuuuagcauuuguguugacaauggccuuuauuuuuccuucuacuuaagggcucucacguucuagaauacaucuuaccagcgauuaauuaugccuugagauugccaggagacguagacgagcuuuuauuguuuuagccacugaauauaccucuagauaacacaauacauauuuacagugacaagcuuuguauuauuuauaggauuauagcaaaucaucaaaaaacaacccaaaaagggccacuuagaccaacauccuuauuucucccucggcuucagcauugaauuaugcaugcauuacaaauggcaauaaggaguaaaggucgguuuagaacaacacagauugcaaaauuacaccauuuguuuaaacaacauucauuauugauuauucagcauaggggcugauagaaacgcaaacaguggcaguaauaucaucuauuuacguaggcccuuuauaaaugugggaccauacccucuguuuagaucggaacaauuguucaaauuuuccagcucuguuuugcaagaaaguaaagaugaauuuggcaucuacuuccuugugucuuuuaauuuuugaaagauuuuugguauucucccuauaucacugaagagagggaauugggguucagauggauuaaguaauuuacuuaagguccugcuucuaaaguuauaaguacucuuuccaucauauaacacuuagcaugucugaagccaguaauuuauuaauaauaguaaugauaauaauuauaaccauaucuaauacauauuaacucuuauuuuaccaguccaugcacaaaguguuuugcaugugcuucgacuuucagccuuuacagaaacccugugaauagacauuauuaugauguucgcuuuauagcugaaacugaggugcaaaggaguuagguacccugcucaagaucacuggguuaguaaguggcagaacuggaugauggaagucaucacuguguuccaguaucugcagaagugucacacuuuugugcuuugaccgucuucucaugacccaugaaugccaugauuucacaaaccuguucaaacaguauugguuuaaugguugauucaaauggguguuccaaagauaucguaaauauauuuaggauauuagaaauaagauauuuaacuuuacuaacauaaaccuucaauuuaguuuuaaagagucuuagagcagcauaaacaacaugacuuucaacuaaaauggaauuuacuaaauaaaacccaagagauuaauuguaggagcuauguccuggugacuugggaaagaaaaauguaaggugguaagcuuacguacaugcuuucggcauacacuucccaccuccagccucgcauuccccugguacaacucaacaggcauuucauuuugccuuacaaauugagugcaaccgggaagcucaucgcauagcugcuuacucagaaaaucugguguaguggcuuagcuagcauaacuuuugagaggucucugugugauggucuuuuuuaaugucuuucgugaagaauucuucuuuuuuuuuucugagacaaugaguuguucugucacucaggcuagagugcaguggcgugaucauggcucacugcagucuuaaccucccaggcucaagcgauccuccugccugguaggugggacuacagguauucaccaccaagcucggcuaaauuuuuuuugaaacuauuuguagagauugguggcaggguuggagggcaggucucauuauguugccagggcuagucucgaacuccugggcucaagcaauccucccaccucggccucccaaaauguugggauuacaggugugagccaccacacccagcugaauucuucucuugaucauuaauccccaccccaccccaccccagaaaauccauguuaucuuuuugcuuagagguucaccaccucuguuccaucacuuuucuuuuucuuuucuuucuuguuuuuuuuuuuuuuuuuguuugacacagggccucacucuguggcccaggcuaguaugcaauggagcaaucucagcucacugcaaccucuaccucccaggcucaagugauccucccaccucagccucccaaguagcugggaccacagccuccugagcacccgggugcaugccacugccaccaugccuggcuaauuuuuauauuuuuugguagagaugggguuucacucuguugcccaggcuggucucgaacucgcaaguucaagcgaucugccugccucaucuucccaaagugcucggauuacaggugugaaccaccacaucuggccaacuucccuuucuaagagcccucuuggggcucugauaugcaccucucauaccucagccccagucaggguuguugaaaacccacugucugcccagaggcugggagcacaucuuggucugccugguauggagggcugggaggaggauugcaggaacugcuuaagaggccucacuuugcaagagcaguucaggauguguuuccagcacaguuuccaacaugugccacccauggcuuccccuuucauguuccuggccuuuaugcuaaguucucacauuguuauuuuuacaagucuuuuccaaggccucugauuuucuagaccauuuaauguuugccauaacccauaaggguauaacugucuuggcacauucagaucccccgucccccugcuguccuucuagucaguuucuggcacacuauguuuaugagcuuacagaacagcuccuagguuuucuuacuuccaaaacagugggcaagaacagcuaccuuuuagaagcaggaaaaaggaacauaaugaauaaaccuaaaggauuuaaaaacuuggaagacacuaagaaacuauauugccgagaaagagaaauguaaauuccgcuggauaaauuagcguuugcgguuacuucucucuuuguugcuuaagcagaggagaaacagaagucauagcaaagagagagguagcugcaaaagcuaauuuauccaaaagaauuuacauuuuucucucuuggcacuauagggggcauguuuacucuccugaugucuuuuggggaaggcgaggcacaaaagaagggcaucuucuuccuucacacacacaccccacuuaggaaaauacguacacuugagaugccagagacacacccaaguagaacacaucccaagaacagucaauaauaauaauacccaucauuuauugaacauccacaauagccagacauuuuucuaguucuuauaaauccauguacuccucccaguagcuuuaugaggucuuauuauucucauuuuauugaugaagaacuuaaaguucaaagaaaggaguaaaucacgaccaggcacaguggcucgcgccuguaaucucauaaucucagcacuuugagaggcugagguagguggaucacaagguaagggguuugagaccagccuggccaacauggugaaaccccaucucuauuaaaaauacauaaauuagucgggcaugguggcaugugccuguagucccagcugcucaggaggcugaggcaggagaaucacucgaacccgggaggcagagguugcagugagccuagacugcaccauuguacuccauccugggcgacagagcaagacuccaucucaaaaaaaaaaaaaaaaaaaaaaaaaguaacucauucaaggcuacacauuuacuccaugaagugagcacacuucagacuuccagucuuguguggccugucuaccacaccaugagacuucaugucucuccuaaaugaggagaaccaaagcuggaaauugucacccccugucagcccacagcacugguuucuaaaccuacuggccucuaccgcuucacuucucacuguaaucucucugacccuaccuuccagcuucucuugagaacuugacucuuaaauucauuggugagaaaggaaauuuuugcuccaauaaacuggguagcucaguccaggagagaaauguacuggacucagacuuggaggacagagcuuugugacccuccuaggcaauguaaugacccucuccuggccucaauuaacugaggccaggagagggucauuagcaaacuguccuuugcuaaaugggacuaaugggaagaauagugucugccaaauaaggugguugaaggauuggaugagacugacauuucauuugcauuuagugaauacuuguugaaugacugaaugaaugguugauguacagaaacaugaacagagaguagagcagaacauuggugaaugguaguagauugccucagacgccccccuuuagaaucacacaagcugucaucugugauugcauaccuguagaagucucuaucauuucguagucuauguaaauguugaccaacugaguuguucaguguacagacugaacaaccauacagggaaucccuaaucuccugcacugugagucaaagagucagacaggucuagaugcauuugcuucaggugaggccaaggcagucuacucuuaauggcacauuaggcuuuggacuugaggccgugucuuuuacauuucgcagcaaucagaaggaauggggucgccccaugaacuucuuaaccacauacaggcucguggcguggggucuucaucuggcuacuagauuguuuaaagaaggauuuuugugauucuucuaggcugacacauugccugucaucuguuguuuuucuaaucuucuaguaaacauuuggaaagugaagguuuaggcauguauguuucucuuauguaggaaggggaaauaaggccaugagauugcaugaguuuucuuuccaaguuugugcagaucugcacaaugauugaaauauuugcaaccuguagagcagcaggguauuuauuuggcagcaaacaguauugauggauucggggaaugccauuugacaguuacaggcucccgugaggcggugcaggcuccuccgagccagggauggagcuggggauugagugacacaagacucuuuggguaugucucaaacaauauaaaucaccagcaaaaucucacuccuacaaggagaaccugcagggagcuccgugggaggcacugcuguuuacucuccucauuccccacugcaaccacgcaauuaaaaccaaggaauggaaucugaugucuaccgcagcgguuuuuuccaucuccauuccuucugcauugggaggcuuaaaaaaaagaaaaauuagaucccagauucuuuauucuuuuggaaggauuugaaacgauuaucacucaugcucugcugcuuugaauggaaaagugauuugauaacuuucaaaacucuuagccuucuaagacuuagauucugguacuaucucauuuaugugacgugggacaaauagccacucucuugcauaggauuuucuuuucuuucuagaaacaggaacugaguauguuuccaauauuuuuuuauuucuccuaaaaaaaucagagacuauauauauaaaaucucacaaacuuuguuucccagaaaaacaacuauauuuaaaugcagcucauacuguauguaaguaugauguaggaaaaucuguuaauugugugacaauuaugacuucugagcugcucauuuauuaaaauauucucccuauaauuaaaaauauuuuauuucggagacauggcuccauuaauugcacauuuccuaaugaaguuugaaggaagauuuaaaaaucauauuagccacuuguacaaaaacaaaccagucauaucauagcauuaauaacaaaaaaauuccacuguuuauuuaacguaccagcaaauucuaccguauauuguuugcucuccguuuggugggacuaaaaagggauuuaaaaauaggcuauauacacugaauguaguuucacuggaagauuuaaugccaacauguucuuuuuugguauuaacauauugcauuggugugaaaacuaaaaugccuucagcgaugaucuuuuccuuuggaaaacuagauucccacucggaugcuacgagggguaaucugugcuaaguuuauggugugucugccagggcucugcuuuaaaaaacaaaacaaacccuuuuggaggccuugacaguuccauggaauuccuaggaacagccuagaaggugaaugaugcagcccaguuguuuuuauucugaguuuggcaaaaaugauagagaagaaaauguacuuuuauguguucguucgacaguuaaagaguauuccagauuccucccuccaaaaaaaaaaaaaaaaaaaaaaaaaagggcauauucccuagccaaggcccacauggcuuuucuuuacuuuaaguacuccucauauuaucuugaccuuaaaguuuacaggguaaaagaaacauuuauggaacaguuaagaccaguuagaacauaacgacuugccucauuaucacacuccacaaaucuccacuuuacagaguucacuucccugccugcuuuaaacauguguuuggccugcaaacaguguuacuagugcucgcauauggaaacagagaacuucucauuccuuaccucagacgugccaaaaauaagaaucuuuaagaacucauaaaguaauuuagcaccacguuaauaaaagaagcaccauuuugaauuaguucuguaaguauguguuugaguuagaaauagaguuuuaaaaaacugucuguucauauaguucaucugcuuaauaaguaagcagcucuuucaaaucaccaagcucaaauaaaacaaacaaauaaugggacaauuggcaaaacucuaaaaagugauacaaaagaccaagggauauuugaaaaauguuuaaaguuauuagcagagaagacacaauuuagaagagagacuguauuccauuuuauuuuuauuuauauuuauuuuugagacagagucuugcucugucacccagguuggagugcaguggcacaaucucggcugacugcaaccucugccucccggguucaagcaauucuccugccucagucugccgacuagcugggacuacaggcacacgccacuaugcccagcuaauuuuuguagagauggaguuucaccauguuggccaggcugguuuugaacuccugggcucaagugauccacccaccuuggcuucccaaagugcugggauuacaggcaugagccaccauguucgaccccauuuuuauaaauguaaaauuaacuuagguuuaaacuauuaauacacaagguugagaaguauagaagugggcauucuaauauacuguggaugggaagaacaauugauuuucauaguucugagauauaauuuggagaucucuaucaaaaguuuuauaaacuuuuuuuuuaccuaggaauuucauaucuagaaaaauauuguaaaggaauauuuaaagauauauccacaaauuuauguacagugauguuuaugcuuauauuauuuauagacuuuuaaaaaacuuaaaauauuuaacaauugaguuauuuuaugaugaucuaaacugcauaggauaaaauccuaugcaguuuacagaaauguaaacuaagugcuucguuaaaugaauccuagaucccgugccuucugacugggugagaccucccagcaggcguugccagagaacuuacacaggagcguuucugcuggaaucagcucgaugccucuugaggacagagacucccagaggaaggagcaggcagccauccuugcugugcugcagccuccacaggugacaccuccuggugugggagggacccaggugaacagggucuggaguagacccccagcaaacuacagcaguguuacugggaagaggggccugauuguuaaaagagaaacaaacagaaaacaacaacaucacuaacaaacaaguucccacaaagaccccauccaaaggucagcagccugaaagaucgaagccagauaaauucacaaaaauguaaggcucauuuacauuacaggcucaggccuguaaucccagcacuuugggaggccaaggcgggcagaucacuugaggccaggaguuugagaccagccuggccaacaugguaaaacccugucuccacuaaaaauacaaaagaaauuagcugggcaugguggcaggugccuguaaucccaccuacuugggaggcugaggcaggagaaucacuugaaccugggagguggagguugcagugagccgagauugcaccacugcacuccagccugggugacaaagcuauacuccaucuaaaaaaaaaaauuaguuaucucugcccuuugggaggcugaggcagguggaucacuugaggucaggaguuugaaccuagccugggcaacauggugaaaccccgucuguaccaaacauacaaaaauuagcugggugugguggcgugccuguaaucccagcuauuggggaggcugaggcaggagaaucacucgaacccgggagguggagguugcagugagccgagaucacaccacugcacuccagcuugggaaacagaguaagacuccaucucaaaaaaaaaaaaaaaaaaaaguuauugauuaaaauuuaaauauaaauuacaaguaauaaugaaaguaugaaauuuuuauugauucauaaauauuugguuuuaaucaaauaugaugugaagcuuuaagugaaauuauugauauucgaaguuuuuuuuugaauguuuaaaucauuucacauucacauuuuuuaaguaaaaugaaacaacuugacauuuuagcauagaauguuuauaugguggccaaaaaagcagauugguaucaugcuuuauguguguucauucuaguccugcacguguagaaauguaagauuuuaaugugugguaagguagauagauagauagauagauacauacauacauacauacauacauacauauaaaauuagguaagaggauacuuuuaauguaugguaagcuaugauugcaccacugcauucuagccuaggcgacagagcaagacccugucucuaaaaauaaauaaauaaauaaauaaauaaauauuuuguaaaagguaucauagcuguauaaaaagaaaagacuaaaaagaaagccacucaaauuccauuucucuucugcagauuuuuuuuuaguuuuguauuucaucugugauugacuguguauguauuuuugcauauauaccugcaagcauuuguccuuuuaaccuuaggaaaaaaagucugauugcaacuacguguuugggaaucagggagacuauggaagaacaaucucagaucucagcuugaggcuccacuugcaauaucacaauuucuaaaacauguuguaugugggcccauuugccaugugugugugugugucugucuaucuaucuaucuauguaucuaucuaucuaucuauauauauauauauauauauauauauauacuuauaaugugguggguucucgaaucacaguuguaauucacauuuuucuccaccaauucugauaacuugcauuaagaaauugacuguguaaguuaaauuuuagaucaauaaugcaaauugcaagaccuaguacaggccaaggccucauuauaucugaguagggcuuuaagaaagcaagaaagaaucgcuugaaccugggaagcggagguugcagugaguugagagcaugccauugcgcucugcuccagccugggcaaaaagagugaaugaaacucugucaaaaaaaaaaaaaaaaaaaaaagaaggaaagagggaaauauacauccuccuauccagggugaauuacaaauaguaccaguugguuguaaguggauuuaaaauuacuuuuuacugcuaauggggcaucugucuucauucaacaaauauauuucggucucuguuagauacaguguaucucuguuagauagagagcauucuguuagauacagagaaucucugguagauauaaaguauucugcuauucugaucuuccuguuagaagaucagauuuacagaagucuacauuugcucucaagggaccuucagucuguuuggagcaaucucuuuauuaauuuauuuauucaguaaauuuuauucagaaccagcuauauggcaaacccuaguccuuaugcugagguuucagagaugauaaugggggcagaugcagccauucaguugacuuccuguggacaccagagaugacaggccccuguccccagcuuaccauccagcauauaaggcauauaugccccuuuccaugaaguauaaucuaaugagaacaguuggagaaggucaggcaaaggggacaggacaggaacucaggaggaggggauauuuagacuuacagaccugcccuaccuaaggucccacagauggucugugaugacagauagccccuggacugcuaagacucggaucuuuaaauauaggcccaucugggcuguggggaggugacagccugagaaaaagucauucuuagaugcccuuacucuguugaucauaaaaguaggagcugaaauucucauagccugagaagcuauuugcagcauucccugagggcuuugaaacacuaucaaacaacaaggagagacaaaacaguuuuuagcccugcucaacucucaugggcuugccuuauuuuuucagggcaugcucugucuccaucccuuggcucugcuuuccuuacauuggucuucuugggcauccgucuuccauuccacaguguagcaagccagaagcugggggaaacauggugcgugccuguaaucucagcuacucgagaggcugaggcaggagaaucacuugaacccaggagauggagguugcagugagccaagauugcaccucugcacuucagagcgagacuuccucucaaagaaauaaauacacuguguccucucagcaagaccaggacaacagugauucucuuuccucaaaguuccaaucagugcccagggcuucaugcauauuggacagaccugagucaugaggccaucuccgauugguccauccagggccaugugcucaccccuuaauucaggaugugggguccggcuccccugaagugcacagagaagagggguugcccaaaggugaauggggagaaggggauauaagugcaggacagguaagaacagcaaaugcucauuaacaccaugcagugaugaaacgccucuuaaucaacccuugcuggcugcaguugauuuguuacuuaccgugagguuaucauagcuuugcagagacuuugugauggggcugucaacagagagaaagagagagagagaaagaaaagaaagaagugccaccaguccauuuuguuccacucaaauguagaucguaauuuuuagguuuguaauuacugaugagaagaaugccugagccagaacuucccagagauuuaucugccacuuaccuggaguaaguagaaaggauaucaguuuuccccaguacaccugccuccaaugaagccaacucucaggcucuagaagucucugccuugggauggauucaccagugugcuucucaggcuggccaguguggaagcagccuugcuguauuucauccuuuaaaaauacagccugcuugccaucucacgacuuuucccuuaaugcaacaaagaaauauguguuuggcugugaaaucuuuuuuuuuuuuuuuuuuuguuuuuuugcuguggagcgcaaaauguucauuuaucucuggaugguuuguuucuggccaccugcccuaaguguaucugaauauuguaacggugaucacuucuugagucuuggucauuacgaagugacauuuggcaugaauuugcucaucaccacagagggccccagggacccacuugggagaaggugaguuauagcccacaagauaacauuucuccuggugacuguccugaaagccuacuuugggccaccacaucaguguguugggagaugaguuaagagguuuuauucuuauacaugcggaagaauuaugccuucuugagccaugcucaggagaugucagccuuuuccauugucuccccgcccccaccgccagcccugcuuaaauuauccccucuuuuuaaacaaaauauccuaaucuuggaaguggcauaucauguuccuucuuuuuuaagagagaaggagaaauuccugcagaucaucagggacugaggcuaacugaagcuuuggaauggauacagugcuacucucagcugaaagcacaaaucacuuccaucacguauaugagauuccucuugcagcacugcagaggggugauaagcaagaguugaucgaugacagaacacccacccaauuucuugacucauucuucaacgggcagggucuauacaugugguauggcugcaauguuuguugauaaccccuacauucacaaaacgggcgcaugggaacuuguuugcugccuucugccaugugaggacacagcaagaaagcacauacaggaaguagagauggagcccucauuagacgccagaucugcuggugccaugaucuuggacuucccagccucuagaacuguaagaaaucagucaguaucuuuguuucuuuccuuucuuuuucuuuuucuccuuuccuuucuuuuucuuuuuccccuccccuccccuucccuccccuccccucccuucccuucccuuucuuucuuucuuucuuuuuuuuuuuuuuuuucagacagaaucucacuccgucguccagguuggagugcaguggcacgaucucagcucacuccaaccucugccugccugguucaagugauucuccuucuucagccucccaaguugcugggauuacaggugcauggcaccaugccuagcuaauuuuuguauuuuugguagaaacgggguuucaucauguaggccaggcuggucuugaacuccugacccugaggcccaccuuggccucccaaaaugcuggaauuacaggcauaagccaccucacccagccaagaaauuaauuucuguugaauguauguuguuauagcagccuggauggacuaagaaucaugaugaaaaguuggguugcuuucauauuuagaaauaucuuggaacgggcaggcgugguggcacacgccuguaaucccagcacuuugggaggcugaggcagguggaucaugaggucaggaguucgagaccagccugaccaacauggagaaaccccgucucuacuaaaaauacaaaauuagccgggcaugguggugcaugccuguaaucccagcuacuugggaggcugaggcaggagaauugcuugagucugggaggcggagguugcagucagcugagauugugccguugcacuccagccugggcaacaagagcgaaacuccaugucaaaaaaaaaaaaaaacaacaaaaaacacgaauaucuuuuuuugucagcuccaugagggcacaaaguuguaucagcuuuuuuuuuucacagcugugucuucauccuaaaauaguuucuagcacagaacaggacucaguaaguuauuugucaaguaaauagacuccuuaauaaauugucuauccuguauccaguacaaugcuuggccuaauauacauccaguuucauuuaauccucaaaacacauugaugaaguggguguuaaucccuauuuuacagaugugggaauugagguguagagcuguugaagaacuugcccaggguugcagagcucuuucacaggggcagagcaugggcugaacaccagaccugucucacacuaaaggugaaacaauuuccccugcaucaaacugucucugauaugaagggucuacacacugugguuugaaggucagauguggccugucauguuuuuguacagcccgagagcuaagaaugguuuuuacauuuguaauuguuugggggaaaaaaccaauagaauaauguuuuauuacauguaaaaauuguaugaaauucaaauuucaguguucauaacuaaauuuuaaaaacuuuuauugaaauuccagagagaucugaaguaguuuuauuggaacacagcccuacacaccuucauuuauaagcuaucuguggcuacuuuugcacuaugccagcaaaguugaguaguugggauggagacuauauggcccauaaagccuaaaauacucucugcuccuuuccagaaagcuuggcaaccccuacuaucaucuccacgucugccuuuguucuucuuauuugucccuucccucugaaggcaggauagcauagggugaccauaagacucucuggaacuagccugcuugagucuagucuuggcucugugcugacuaccuguagggauguaggugagcuuuuuuauuuuucucaaccucagauuccucaucaaauggaagaaauaaugaguauccacuaccuuggguuguauggaaugaaccaaguuaacuuagcuaaacucaucgcuuccaacaucgccuccuauguaauaagugcuugauaaaugcaaguucuauucuucuauucucucucucucucucucucucucucucucucucucugucucccucucucccccucucucucauagugauaugguuuggcuguguccccauccaaaucucaacuugaauugcaucucccagaauucccauguguugugggagggacccaaggugagguaacugaaucaugggccccagucuuucccaugcuauucucaugauagugaauaagucucacaagaucugauggguuuaucagaggguuuugcuuuugcuucuuccucauuuucucuugccaccagcauguaagaagugccuuugccuccugccaugauucugaggccuccucagccauguggaacuguaaguccaauuaaaucucuuuuucuuccaugucuuggguaugucuuuuucaacagugugaaaaugaacuaauacacauagacacauacacacauguacccacacacacguaauuuuuguaucuaagaaaggggagaaauacuuuuuaguuguucuuucugcuucauuuauguguggagugcuuaauguggucacacggauauuaauugcauguuuucuuguuuuauaauuaagaaauaaaaaugaaucacucugacuuuucgcuucauuuucugcauuugcacaauuuggauauuuuauuuuguagucuauuaaaaugugaaagucaguguaaagugucaguagcuuucaugaguguucuuaaaggaaggccaucugauuggaaugcauuguaucuguccuucccucuugcuggggucagcccaggacucgaggggaaugagccccugaggaaggcucaguccuuggcagcgaaauccaggcauggaaaccaagccugagacaugagcugcaggacaucugacacugucuuuuaagagaccugccugugagguccucauccugcucccuacacugcuucagauccacuuguccacuuguagugagggauaguaucuguuccaccugauugauugauugauugauugauugauugugaggcagggucucacucucauugcccaggcucaucucugccugccggguucaagugauucuccuucuucagccucccaggagugccauggugcaaucucaagucacugcagccuugacuuuccaggcucaagugauccucccaccucagccuccugaguagcugggacuauaggugcgugcccccacgccuggcuaaguuuuuguacuuuuaguagagacaggguuuugccauguugcccaggcucaucucgaaccccuugacucaagcgaucugccugccuugucaucccaaagugcuaggauuacaggcgugagccgccgugucuggcuugcuccacgauuuuccucuaugaauuccaccuuucccauggugggaccaaggcuggaaguacuucacaaaggcuccauuugaaaaguggcuacaaauaaaagggaaaauauaguauuccuuaaaaaaaaaguagcauucuauuuuuccccauugguaaguaguacaaauuugagaaaguguaaauuugaauuccuuaauaaucagaucucugcaauguguuuugcuuuuaucauccuggguugccaucuuggccaaguguagauuauucugcucaggguagccauacugagauccuggugugcacaggaaaagagcuaaccuuuguggaugaaauuguagagucacuaccugcauuugcuguagcucuuacaauuauuuuauuuuuggaagacaucgagagcaugguccaaagcugcauagguugcaaguggguagaggcagaauuucucuccaggccugguggauucuaaagcuguuuacucuucacccaccauuuccuaggucugguuucuugguuaaauacguggaagaguggauggacagaaagacagauugaucaguucuccacaggcuuccccaaacuggccagguagaaauaagcuaagcaaauaaaugacuuccccauuuuauaauuuucugcaagucacauaagccuucauguuguuuauuucuugguuuuagauuuuuuuaauuauaaaagaacauuauuauacauuauuugaauaauuuuuuaaaauuauagagcugucuaaaggaggcauuaaaaaaacccuuucuauuccuucaucuaauucuaucccucugaggcaaccaugauuaguauuuuguacuucuuguacauccuccuucauguuaauauagauguacacauauauaagauuuuguucucauuuucugaaauaaguggacacauacuccaccauccccagguaguguacagugugugcccuuucaggcuaguauguacagcuuuaaaucauuccuuuacagagcuguguaauauuccacaacccagaggagcagcuugaagccagcuaaaguauguauauccaaguggaauuaagagcuucaugcguaguuucuugauuuugauuaagaaucuuucuuaauagauaugucagacgugacuuuaugcugcaagacauagcauagguagaaauuuuuaugucacaggugggccuaauuaaccuugauuaauguucugcaaacccggauagacuggagacucagaaagggacgcaaaagcuagucugguucccauguuagucccugcucugugagcagcugccacacagucaugcugauggcuccugcagcagccauucugguuugacugugcucgugcugcccugugacauauuguuuaacacagugaguuaugacacagggagcgaaaucaagacuucagccaccgauuuaacaaacuggugacucggagaucagcaguccggcauugccauccucaucaaaagcucuaucuuuaucuaaaauuuauuagccaacuucaaaccuguuugccagcucacuaauggaagccuuuugaaucaauuugcuccucuaauuuaaacagcauuucaauguauauugucgaagcagaaaggaguugcagcuucuggccaguagaauuaauuauuuauuauccuuuucauaaauacuuuccgaggccgacauaacugaaaauugcucaggcuguuugaaaacacacacacacaguuuuccaguggcuaauuugaaaaaugucaccguauuaguuuucauuuacaucugucaggaaacauaucuauacauaaggaaguuuuuuuuuuuuuuuuuuacuuucaccagguauuuuuuuguggaguaugcauuuaauucacauuuacaaauugguuucuguuuuuaacuaaagauacuuuuucagcagaaaugauguguaugaugucauaucuaacuuuugaucucacugguauuugauguuaagccucaaaaucaucaaauuuuuuuuacggcacugaaaaaaauacauaaaucugcuugauugguucauagaaaaagaccccugugauuaagguaaugcuaguuuuugcauuuucuccuagcugucauugguuggacacagugauccucgggucucuuguguuuucacaugucuugggaacagaagugcuggcagcuuugguuucaggccaucuuuccaaggaacguugucuagcaaagaaacuugcaagguacagauagugucucccucaggagcagaggacaggauggcuuucuuuccaguauaauaaagacagugccuccuuccaggacaacgguuuggcagauuugcuugauaaagguugggguuucuaagcuuggggcuccucagccaugacugaaacguacuaugagcacggcaucuaccgggcuguuccacauccucccugugggacuaggggccagggcaaugggaaucagugcagaaauaaagcucaugcuguuugcucugccaugaguaacgaaguccucuguaucugauccugggucuccuguuuucugcuagcuuccucaaaacuugguagcuaacucauuaacuuacaaggaagagggugaacguguagacccuucacaguuugaaaaaucaccugaucaauaacugagauuaugaaaagguaggaaugaaccaauuauggcccaaaggcuaacuccagccaguagccuuuuauuuaugacccguuaaaaaaaacaaaaaugaacaaaaaauccaaagaaggcugugugccagagacgauacguggcccgaagaugaagguacuuaacuaucuggcccuucacagagaaaaugugucaacccuuuccuguuugcguucaggucaaauaguugcauugaaaggccucaucuuacaaaugaaucaauauuuagugguuugaaaauauguuguuuaauuuggggcgauucaauaucaaauuaagauuuuuagguuuauuuaucgaucuuuagaauuacaucaacauuaagcuaauuacuuuaaauuguguuuuuaaguaaccaagaauacaucuguggacgcuguucugugccaucuugagucacguuuuuaaaacaauuaccuuugaugauuucguauguuaucccauucacagaugguuuuuuucguccaccugaguuucaaaucuguuguaguccuggaaauuuugcuuagguugaaggaaugagugcguguaucuugucaaaggaaaucacaagcccauguaaacucgcucuugcuuccgucaccucgugcuuugaaacauaaccacagugugcugagguuucacauuguuacauccuacaagcgugcuuaccugcaucaccuugcugggcuguuucagcauuggaauaucacugggaaucucaaguucccaggagccaaccacgagagcuucacagcucagaauuuucaagauguggauguaggcagggagccuauguaguaauucaaguaagcaucucuucuucuuguuuuccuuauaggaugauagaaggucagugcuuguucaccccagugagguggagccucugaggugggagguuuucucucauccuugaguuuaucuuuacuuccuggucauuaugcaaguuaauuuuucuagcagugaaaacagucacaugggacucugcccagcgagggcguugggaggccuggcggagaagcaguuguagcaucguccagccuucucuaccuaacaagggaauaugugagguaggguaggacauuuugguagcagucacacagcccaaagagcauggugaauuuaauuagucugccacaccuguauggccuuacguuuuccgggauaacuuaacaagcauugugugcagccaggucaggcagauggagguucuaauccaggcugcacaccucaucagccaggagacuacagauaagucagccaaacuuuuggaguaacaaguagcucaucuguaaaacguggauguuccaauuuauguauagccgcauaauacauuaccccaaaacuuagaggcuuaaaacaacaaccauuuuguuuuaucuugugauuucuguaaguuggggcucaguggagugacucuucugccccuugugguguugacuggggucagucaguggugcuaugcuggaggaugaauuggacuggcacuucagcugguccaggauggucacccaugggucuggcacuuucacgaggaugacugggaugcuuggcucagcugagggacucuuacccagagcccuacacauggccuuuccugcauggcagauauagggccaucagauuucuuacaugguggcucagggcucccagaggauuccaaaagaaaguaacaggaagcugccaguuucuuauggccuggcuuagggguuggcacagcaugacugcuguggacuaagcaguuacaaaacccacucagauucaaggggagcagacauacaccucacuuucuucugguagaagugacaaagaauuugcagccaucuuuauuccaccacagcagguaauaauagcaucucccucauuaccuauagaauaacuccaaacuuucugaugauuaagugagauaucauguaaaguaccaagcaccuuggauaggcaaugggaaauguucacaacguucccauuuuuaccuauaacagcaguagcaauaaugcuaauaguaaugauacuaguaauaaaaucaggauaaugcuguuuuuaauucaccacacuguaugccauuugcuuaaaaucagaaaggacucaucgguaaggaguagggugguaguaucauuuuggucugccuuucacccccacaagacaacauccuuaacagcagcuauguugaagguuuaggagugcuugucauuagggucucauuuccaaaaucugggacauaauaauagaugguuacugauuacagggauuuuuguuuguuuauuuguuuguuuguuucuucuugauaaucucuuucauucaucauuccuucauuuccacucuucuaauucugggcauuauaucuuugucagagauagagucuuuuagcuguuucuucaccucccaaauccuucucaagucuguucuccgccugcugugccuuccuauaguguagcuccaauugccuucauccuuagaagaccuuuaaugauauccuaugccaaacuuccuagccuccaccuguacccugaauuggcccuagccuaguuguccaaacuuuauccccaggugguugaacuuucuaaguuuccccaagcugaucaguguuuuggggugguauggaacucagaauagaucacuuuuuuuauugacuaacucugaccauaaguaugcuucugugcgagccugaccuccacgguaccaggcagagaacaacauguaugcagagaacucauucacucaauaaacauuuauuaaauccaagccauggggauccauaggaggaauuuagagcagaguugucgaauggucagauuugccuuucagaagaccguucuggcagccaugugagaaaggaggguggggagaccugcugggaaacaacucuagucacccaggcacgaaaugaugagcccuugagcaaaagugauugcagugaguacagggaggaagaggaaacauuuugauagauacuugguaaaaucaacaagauuuggccaacagcucugaaggggaugacaggcguggugaauggagaaggaaggacagaaggcuaguuugggacuucuggcuuggacaguguauuguguaguggaaccaucgcugaagauaggaggaguccuuuucagucauacugaauucaugacgccuguggggcacccaaguggaagucauccauuggcaccuggauuuagaucuggcacucaggagggauggacaggauagacauugaccagacacaauuauauuggcauauuuggacuggagaacccagcaucugacuuaaagagucugcuucucuucaaaauugcuuagguguuuucaaacuacaaacaaauacacucccaaaaccucaauagauucucccaguauacccuauauuuuggccaaacuggaaucacauccuggucuccccaaacacugcuugcuuuuuguuccuuucuugcucuuccuucugauugcaaugaacuccccauuuccaguccccauccuccaaucccuucauguccagcuccugcucauccuuugaaacccacuggauuuuaagauuccaucugacaagaaugaucacuguuccuuccaguucuucaagcacuuuuucuguuuuugaugggauuuaucacuugaaaaugcauauuauaguaauuucugaauucauccugauucuccuacugguuucuaaacucuucagguuagaauuccuguuggauaucccucuggcccgaaauuccugaaugaguuaagcaggacaccuagaacuaugcagagguaauaccuuccuugaccugucccuuuucugggucaguuugcccuucaugauuucggcaggagugugucuccuuccauucuggugaacacauccaauguucaauguugcucaucaggguaagaguucuaagucccuaugucuuagagacagggguuaucuagcuuugucuucugcauuggcuucaggcuucacauccuuccuggacauguucaaugcugcuuucguuucuugggcgagggcccuagaaucaccuuagacaccuugcucuagacauggccccaucgugguauucccuuuugagaagacaaagauuuuaaaaauucuuucucccuuaaugccucaugaaugcccaagcagcacuucauggaaguacacugagucucuacugcuugcagggauuaaacauaacauucucaacagugguaagagagccuuucccuucucuuuggcucguuuucaguuuuuauuaauuuccugugcuucugguucaugaaucccaagucaugaugugaaucaguucaguucagcaagcacugagcucccaugauauaacagguuuuuuucuuuuccgagcuguggcccaugcagaguuuacugagacuuggcucuugccuuuaugcuuuaaggauccuaaagagaagauguaauuauaagaucuaaaacguggagggggguggugaauucagccugcaggcauguguuugcugcccccacccccacauccucuuuuuuuaaaguucgcauaaaaaccuggauucuugguuucucuuaaaaaacuggaaggucuggcaccuuugcucccacauuucccgggcgcagcccuugacucacccuguacgguggccgccccaguuggaugauggggcuugugcccaccgggucagcucacaccaaccagccccuauuaauuuauaccuggcccgcuuuccaaauugacauuaccuggcugguccguacgcauccccugcaguaacuggcuuucuggagguaugugcugaggaucucuuuggcuucugcaucucaaaggaugagugauuuagccagguggagagguuggggcgguauccugaaugaaagaauagcacagacaaaaguagugaguugaaaacagaacagcauggcaggcucccaguaaucccaugagucacguguucugcccacauggaauggaugguggagaagggaggagggaggagguugggccagauuaagcagauuguccccauugguccauuuuuaaaucuuccuuuugguauuugucccuuaaggcaacacuuucagucucagaaaaaauccaguaaagggcaaaccaguuugggugaauuucuuuguuuuugcagcaugucuggucccaaagugggaccuggaguccuuccgacgaggaagugcagccucuugucgaggagugcacugggaggggaggcuggacuucugggcucugcucugccucuaaucugcugcccagcaucagccuuagcccagacccccaaacuuccugggcuucauucugcuuugcauucaucucaaaguuaagccuucuggcuggcagggguuucugagacagacugacaguauuagcgugcugcaguuucaugauggcaagaaggagguuaccaaagccguuuucauacaccuuaacucaugagugguagugaguggccccaggugggaagcacaggugauuuggagcuggcuaaccuccuuccuuuggcucuuacucucaccagcucuuagacuugggguagguuaguuagcuccucccagccucaguuucccuguuugucaaauggggucauagagggugagaaucagaguuuaugcagggcauagcacuaguguaaugcugggcagagagugagcauccagcaagugguuuugacaaugauaauaauuauaacccaagcgacacauacaauuuaaucaggcacuguguguccacagcgaugucaaggaacaaugcacaaagcagaguuuuuccagucuccugauguuugagcccugcgcgagccccacucuucucccuuuucucauaacugcugugagcaaccucaaauccuucuggaaguagguugguuaugaauuaugaauaauuaaagaaauaaacucuggcucugcagcugaaauugggaucgcauggagaaaauagaaaguccaguguuuguagcugugaucucucaguugcuugcaugaauugugcuuuaagauuguaaaauuuuagcccauuaaaaauaaaaucuguugcuuuccacccacaccuggcaauuuggugagggacgggggcuaggauauuuacugucugaaaguuuuagggaggcuuuuaugaacugggccaucucuccuuguccccauuuuucuuugcaucuccgaacucucauuaauuuuucacaggcuugugauggauaguuuuuauuuauucacgucugagauuccguugugugaaaaggacucauuuuauaacauuacauauucauggcuugggauggaugggauaaggaacuuauuauuaaugugucacugugggaaacuuacucuaguucauuugcgaaccuuguuaaauucgguguggucagcagacccggugaaguuuuggauacauucucuuaacagagggcaaagaguuugcuguugcuuuuccuugauucaguaaaacaaguuuaaaucuuauuuaaaucguuugaaguagcaauuugaaaggggaggaaaaaaagggggauggcagagauuaaguagagagagaagcuccgauuuucuuguugaauagccguguuuccucagcauucuguagauuuuuggccagguuuguguaagggaugaacgacucucuauaaaaugaugucaggauccuuucuuuccugcccauugccauuucuagcauucucuccuugagggaaguugcaguuuucucccucuguguauucauccuucugaccugugcuccggauuccagggaguucucaauuuggagcucauaccgacaucacagaauuccuugccugggacaaauagagggaauauuaacauagcaucuuguaaaucaaagcugggcagggggugggggagggcacaguggggaaccuggcccaaucugcuucagugugagcuugguaagaaggaagcauauguugcauuuaguucucugcaaagacaggcgcugcucucuggcagggacagcguguaggguuugcaugauuuguggggccguuucauguuugcacgguuuggcuuggcuugggacucggccaguggucacugcaguuuaacagauuccccccgggugugaaggaaagcgagauaaaugcaggaaaaaggauacauuuugaaaucuggaaauuuuacauaacaggcaucagauuugaagaauguccaaaauauuacgaaucauagcacaaccuuugcuaacaccguggaaauuuuugaacauggaauuuguuaaugcugacuuggcccaccaugggguuaaaaaaagugaauuucuuuuugauaaccaaggugaugaucuuaugaaguugaugauggggugugaacggugugagugggggacaaagcaaugaaauaucccuuaaaaugcauccucugaugauguuuccauaaugccaaacauuuguuucucuccaggaucucauuggcgguuugcugguauuauauugccauuuauauuggaaaggcaggcagugcgaaaacuguagucuauuaagaguuugugaguguguguauguguauacagugaaauaauaucuaguguaaugugaagugacagucaaaauuacagcuuuucucuugccgcaaggguacuucucugccaaguauaguaauauuguuguagcaguguucaagguugucagcaauucuggcuuacucugcagagagccauaauaguguguggaaggaaggagcuuccugucaggggaaauacuauaauuuugauauauauuuguuggugccaaacugcaauuaaauaggagguguuggaagaagguuuuauuuaaccagcuugaauuuguuaauuaauuagcaaaaacuuaucuuuggaaugcuucaagaaacaguucuauguuguucucauaacuuaauuuuacacaacugucuuuuguuuguaucuuacagaaaacaaaauaccacccuccgccagaaaagugcagaauaaaaauuuuccacuagcaaaagaaggaaaaaauaaaagaucuugaauagucucaucaauuacaucuucuuuuguggguauuuccuggucuuuucauguuuugacuucuaucucggugaucugacagacauguacgauuugcaacaacaucuauuauaugauuuaauuuauaccuuuaucaguuugcaguuaugcuuuacgacucuucaggugacuaaagaaaaagaggguguuuuaaaguguguguguuugugugugcguguacguguauacauguguuuuucuguguacauaaguguguguguuuuaaauuguuugaaaaacacuaguccaucucuauuguauuaucugagggaugcuagcucguuacuugggauaguaacaaguuucuuggugacaacuccuccucccauugucaaggaagacugaggaugucaccagaguucgcugucaauggcuauucagaugaaaaauaccuucuuuuugaauaaguagaaaaaccaugggggauugaaauagcaauaauauauuaaaagcuccaaggcaguuaugugugaagaaauaaagaacagaacagagagauuguguuguuuuaaaaagggcuauuuaagagucuugaaaagaguguguguguguagggggacaccucccucucauauuaaguauuuugcaaauuaaaugaguuucauucuccuauaaaauaugagucuaaucacauuuuauaugauuguaaaaugugucuacuuuugucucuaucuuucauggaaaaaagaaauauucccaaaguauauuauaaaaaauaauuaauaagcaacuuuucaucauuauuuucugagguuaauuauuacccuaagaaaucaauuucaauuucuucaguuugaaagacucauuugugaugggguguuuccaaaaagagaguuaguuaaaugcuauauggaagccuucauucccuaaagaaaaugccucugcugcuggcagugauuuauccagagcugucucacccauuuaugccccaugccaggagaauguauggaaaauguaauagagcuauuagaauccaguguaguagauugguaauaguaaggaacaacaguugucuucacauuguuaaaauaaaagugagauacccuuuaaucuucgcaaagggaaauaacucuucugcuaacccuccugcccaaccugagaugaaguaucaggggaugcaguauggauguauuuuccugacgauugguccuucuguccugggacccaggugugagugcauagggaaaagggaggagaaauuuaauccuguaacuaucuccuuauggaaaacaggaaaccacagaugaaucaaaugaauccguuuccccucuuucugauccucugcaaaagucaucaaaaucacucuguucucaccaggcaacuggaguuucgucagcugagucuagaguguuccaggcaguuacagcuaaucauggcaggcucuacccaacugggggaacaauuuagcuguugugggauuucccuuuaaauuaaauauguucuucagguacaguuuuuuaaaaccaguuuuucucccccacuuuuaaccuacuuuaucguccauugcugggccuagaauugcauguccauuggcauggcugacguuauauauaaauauuuggaauuguaguuguaaugauagauauuauauauauuucacauguuuuaagauuaacauauuaacaguuugugauauucaacaaagaaugcaauaacuucugcgaaacagguaagagaaacaaccagucacuugaucuggauauugagacguuaccuguaggauauguauuaggcuguucuugcacugcuguaaagaaaugcuugagacuggguaauuuauaagaaaagagguuuaauuggcucacaguuuuguaagugguacaggaagcauagcggcuucugcuucuggggaggccucaggaaacuuacaaucauggcagaaggcaaagagagagcagcaggugacauggugacagugggaagugacagagcguggggugggggugggaggugccccacuuuuaacccuuuuccuguuuaggaaaaaaaaagcgcagcucacugccagcgcucauuuaauuuuacauaaacaugcucuuugaagcugaagcaaaugugaccgauuuucaaagugauaauaaaauauaaaaacaguucuuggaaauauuucugaacagaacuaacaucagaaucaucugaaucaucagaauuguguauuuuggaaaaaucggauucaucaaaugaaucuucagccaacaacuguucgagaauuauguuaacaucacaugcaggaaugcuacauuuucucggauuugacauuuucagugauggagaacuauuauauuuuguaaauggaaauaccacuacuaaaaacagaaggcuauaaauagaacgauauccuucguuuccaaagucgauaugcuagagugaugugaaaaaaauaauaaaagcgagauauuucauggcaaagcgaucucaggguaaacacugcacaccaguaaguauucuuggggcaaaugggaaaaggguuaaaaugaccagaucuccagagaucucacucacuauggugaagacagcgccaagccaugagggcuccgccccagugauucaaauaccucccauuacggacauguuucaacaugagauuugggcggggacaaauauccaaacuauaucaggaucccagcagacuggguggguggagguucagggauaucugggaaggacuaagaauagcuuuuucuuuuaguagaucaggaguuuccucuuacacacaaaaagcuccaaauuuaaacuagcuuaagaggaaagggucauuacuggcugacaaaaugcgaaguuuugugcaagagucagcaaaguuucucugugaugggauauuuaauaaauauuuuggggccuuguaguguuuguugccaacuacucaacucugcccucauagugcgaaaacaggcauaaacgacauguaaaggagcaggcauggcugcgagaaacuuuauuuauggauacuggaauuugaauuucauauacauuuucaugugucacaaaauauuauucuuucccccccgcccccaaccauuuaaaaaugugaagcauuuuuagccugugugcuguauaagaacacagccguguuuggcccagcgguuauaguuugccaaccccugcuuagagucuagcuuuauucagagcuuaaauaugucaucgagguccccucuuuauuuaaucccuuaguuuugaugaucuuuuauggguuauauucuucaaagggaaaauucucuccaaauggggcugccacuggcagacgagcacugucccaucuuggcuuguucccccagugacaagaagcuguuuuccccacuacccuuggcccaaaagccacagggagaaccaggauuggccuaguuuuaggcagacaccuaucccugaaucagucauguccccggaugaugcgguucucugcagccugggcagucaaggcuggagauaauucucugcuucuccacggagucugagaggccccguucccuaaugguaaaaugagguccaauuuugcaaaaggaggcaccuggggaaacauucuggacacacaaaucuauagcuucuaccgucaaucugcuaugauccuuuuaugguucugacguugcaauuuuauuuuugcauguuucuagagacaucaggaggggaucuuuucgggauguggcuucaaaaaggagccuguuggauggucucuuacuaguggucagcaaagaacaguucuuuuguaaauugcacugcauuaagagcauuccuguuuccaucucauugauaccugccuugcguucuguuaccuggaagcacaggucaagguagucuucuuguuccacugauuugaugggggucaggaugcuuucagaaaggaagugagaagaguggcuuagaacagggaaaauguggccgggcgcaguggcucacgccuguaaucucagcacuuugggaggccuaggugcgcagauuacaaggucaggagauugaggccaggcuggccaaugugaugugagaccccaugucuacuaaaaauacaaaaaauuagccgggaguggugguguucgccuguagucccaguuacucaggaggcugagccaggagaaucgcuugaaccucggagguggagguugcagugagccgagaucgugccguugcacuccagccugagugacaagagcaacacuccaucucaaaaaaaaaaaaaaaaaaaaaaggacagggaaaauguccaggaaggauguggcuuagcugaagaucagcuucagcuugaucccacgggaagcucuggagggugaauuguacagcagaguugguccugacugagaccagggccuggcugaccuauggcagucagcgaugagccagugucugcuggggaagagggcggcguggacauagccucucaaguggggcaggaagggguagcugugagauacuagcuaauucuuacagcuucuggguucaccagcccggcaggagaaucuggguugaggaggcaacaugacaacgugccuaccuucaccagagagacugcugucaaaaaucacuccauccaugcaaggaggaacgaugcagacacagaaauucucugcugugagggccagcacuguaguauuuacugaccugcuccccacuccacaccuccaagugcagguguacagacugacaucaaaccuuucaucccgcccucggccucauaccugcuuuccacucugugaccuauuuacuucgauggagucauuuucaaauaacuuuuguuuagugaaacucaaggcuuuucaggaugcugugcuaaugucuuccuuuuuuaauugaguaaauauauuauacacagcuggguagguuguuuccuugcuggccuuacugcuacaauuugaaaacggauacaguuuucuuuaacucacauaggaugaauguggcauuuauuccugguuuccuguggcucuccuccuuuagaaaacguauuuacauggacguuuuugaagcacuucuuaagacaucgaaaaauuaaaaaagaaaaaaaaaaagaagaaaaaucucuuuucccucccccaaacaaugguuacauagugacaacaguggguugagcuaaauucagcuacgucaaggaagagcaauaaaaggagauggauuguucucuaagcuucacuuuauuggauauuguaauugacauauaguugucauuuauaaucaucuguccauuccugugaggugggagcaguaaaguuaauuguggcagcucauuugcauuaaucucaccucugaaggguacaguaacccauuaauaucacgucaugaugaauuaucacaaauaacauugaacauauugauuaaugaucucugagauuuguaucucguuaaaacauuuuguuagcucuuuaaacuuuuaagccaacaaccauugcguguaggagggguuuagagaucaucugagagguggugguggguggugguguacuuuguagggucacugguuuaagggguuggacaacccguucccaucugauuuuccucuucuucgggagccaaguacuuuuuguugguaacuuccgucuacuuuuugcaggauagugguuucuucaaaacaguggcuucuuugauuguaagguggcuccgauucucaaauggaaugauuuucuuaagauuuuuaaaaauuaccccuucaacaccuuaagugcuggcuuucugaaccucuugcccaccuaggcaugccugcuacuuugaaguggcaagaguuaucuuugucuauuacaucagcauuccuaaacuuacauguuaacauaaacauggagcucagaggaaauguguuguuugagaugaaccaucguuucaaaugucacuuacuucuuguuuuauaaaguaucauuacucuuuucuuggacacagucucaucuuugagguguuugcagauuuuaucuccuguggacauuucuacaaaaucaaucaacaaacuugagcagagaaaucaucauacuagccacacacacucugcaggcauuaauaaaauaauaguaaauucucuuuaaccaaguccuuugcagaauuuccugguagaaguuuaaaugcaauagaugcaguaaagaaaaggguuggcuuaagaguugacuuacaaagcuugguccuaacagcuuuuuccuuuaucuguuucaagagucauacgauauuugaucuuucaaacuuacguauuucuuccauuauguuuaguauuaguuucguuuucucaagauacauauuuaacaacuagcaaaauguuggaagcggucuccucugcugucuauuuagggaaaauggaacugaucuuucugaaauaggcaugcauguaaugaugaugucauuaaugcuuggcuagcugguggacuuaaacccagagggcacuucugaaaaggggcaaagugcaucugcuucugcuuuguuuauagacugucagccuuggaucugucacucccucagaagggaaggauugaggccaggcaagguggcucacaucuauaaucccagaacuuugggaggcgaggugggaggaucacuugaggccaggaguucgagacuacccugggcaacacagugagacccugucucuacuaaaaaaagagaaaacaaaauuaaccgggcuggguggcacccaccuguaguccuuuggaggacuacuugggaggcugaggcaggaggaucacuugagcccagaaguucaacauuauagugagccacuguacuccagcuggguaacagagugagacccugucucugaaaaauaaaaacuaaaaaaaaaauuaaguuagaagggagggauuacgacccucauguguaucaagaaacaagcuccaugaagccccauaggauggcucagcaccagaacgaggucugacuguuaagcaaagucaagugcaugauggcugaacauugcugggggaagauuuugcaauuaugcauuguuugugccuuuagccaguagguaaggacagugguaccauucugacggacucucggaugcuugguuuuauggagggaucuuaaaacaguaaucggcccauaugugcagcaaccuuugcgccuaaauagcugaggacaaaguagguugcuuacuucaagagcccuucccuuucucuucuuugucaggccuguaauguuccucacccacugaguauuuaauaucuguguuuucacaucaaagaacaagcuuucugucucccaggauaguaucuuguaaagccagccucuuuauuacuucaccaguuuuaaggcuuuauuacuugcgaccuaaagccugcuagugaauuaugcauguuagaacucacagcaccgucucugcccacucuuuugccaccuuuuuggggguccaaaaaguacaaggcgagaucgacguguguucauucccauccaugguauuaauccuuauucauuuaaaaaaaucugcuaacggaaauauuuccauucagcucauuaaucaauugugauuuucauucccuuguuuuguaaaagcuguugcaauaaauacuuuuuucacaaggcgaaaauccaagagauggaugcagccagcguaauuaauugcacccaguuacaggagaucagcaaguuugugagauucacaugcugcuguaccauaugguugcccagugggcgaaaaauuugauuaauguuuugaaguagauuuuuuucagcaaauauugcagccccagaugagguggggguugucccccccuuuuacuuucuaguauuguuagacuuagcugaaggaaacaauccucugauuuaaagcuuaauaauacugugauucagugaaaacuuaacaugcgauaaaaauuacauuucucucaucucuuguggauacagaaaaauaauacaugaugucuucguuuguaauuaaggaaaaugugaucguuggauucuaaaacuugauucuugauuuuuuuuuuccccuaagaaauggaacugugguuuucacugaugcacuuuugguaugauuuauaaguaguauauuugggcagacucuucauacucaaagcaguaaaaaauaaaauaaaauaaaauacaaugaauccacaaacagcuucuucuucauuauguacccuauaccuauuagagcaucauaaaauauaacuauaugaguaucauagaaaaguuaaagcugucucuacucuguuaugcuaagauauauuaguuucauaaccacucaauauauucauaguuaauuuauccuuuauuuuaaaaaaauguccugcagauuuuaaaaucaauuuuauaguuucuuuucuguuuuuaguuagaaaguucauuuuaucuuagcagcuccuugucauacugggcacccauucucuuaggaugcugcccuucugacuuuuuucuccaauaccugggagggaauuagccauuugguaauacaacgggacaagcuuaugguaggucugaccucagcauucagaaaaacaaugugaaauuuguaauaugugucagaacuggcaaucaacgccauaaggacaauaaaauaaaauacauuucuccacuuuaguaaaugaggcuucaugcuuccuauggcauaacuuuuuuguuguuguuguuuuuucuuuucuuugaaacgguuuuaaauuucuaauugccuaagcaaucuaugacacuccuucaaucuuaaugucuguugaaaugaacuagcaucucaagcaguuggagcaucaucuuuaacuagacaucaaccugguuuugaauccuuugaguuuuggcaaauagaaaauucauccagggccacaaaaaauaucuauaauuuugacccaguuguagucuagagagauacuuaguucaaaaagaauuguguuaucgucaucaagcaaaacaacaguauaugcuaucaucucugagaugucacacgauuauugcuuuuuuuuuccuuuuaaauuuuuucuuugugucuaaagcaguuuaagagcucuaagugugcucuguuuucugauggcuuaacaagggacuggcucaaucaaaauagagaaggaaaggacggagaccaggccaaaacggccaucuccucugauuuucgauucaugauauaaauuuuuaaacaaaaaaguuacaguguuuuugguacuuucacuaggcuucuaauuuuuuuuccuaaacuuaaaaaaauuuuuuuaagaucaauuauguaauaauuagccacaaaggcacaagaacuguuucaguaguggccuguuuuaauguuccauucugaagaaacugguacagccuuucuuuccugaguuugagcugaaacucucucuuucccuuuuaucaggucgcucaaaacagauuuuuagagugaagcaguuuuagggacaacauuuaggagaaacauuucccuaagauucccuaacauuuuuuucuuuaauuuagccauuucuaaugaauauuuuuuaacugugcaauuuaaguaaugauuuuuuuaaugccugcuaccuucaagacacuucguguggucaccuccaauuauagacuagguuuuuaaaugaaaaacggaaacacuuuuaaauuuuuauuuaauauggccggugaaacaugaacaauauaugaucaguuggcaggagacagugugaugaauuauuuaugaguuuacuuuuuuuuuuuuuuuugcuuuaacagcacauacauauaugaaauucauuaccaagugauaggacggguaacccagagguucugaugagggccaggaccucauggucauaaaaguaacauuagaccuauuccuaguaauuugaucuagguuggccugauuuuuguugugguggcagugguggcugugguugucaauuuaauggaauguauuuggaaagagcaagcuucuucccaaugcaguguuuucccugcaaaggagaagaaauauauuucuugccucucuuuccuuaguccugugugcuuccccuugauuucaccaggacaauuuuauaccaaucccuuguauuuuagaagagccugauacauuugcaaggucucucuuuauauuccugaauuuugcaucccuagacaucauccuuuuugagagagaaaauuccgagugucaguuuuccuuuaucggaaccuccuuuuauuugaacuaaccacaaugggucauaauuuauaggcccagucagcgcaucauugcucagauagagucauuuaccuacaaguauccaucaguuaggugggggcugcuagauuuuuuaaguggaaaaaaauccaaacagguucaggaagaagaagaaaaaaucauccugggggcagaagaacaacaacaaaaaauuuuccuuggggccuuccaauuugagauuguugaguguugccaagcaaaacuaacacgcagugggaagguucugcuuuucucacaaauucucgguuaacacaaggcgugccaacagcugguagagcgagagucagggugccaggcugaaauggaguggaaggcagcccuggcuggaagucuugcugggaaccuggagcgcugggagguaaaacuuuacuuggugcuggcagcgucacuaugccagucuguuucuucccgagcuucaggccaugcugauguucaaguugaauaaaugagagcuaaugauuuuuuaaggcguuuuuagugaauugccgugggaaugcuaaguuggcaagaauaaaaccuaggcgaggagaguugauuuuugaugacccaaagaaggcauguccuagagugguuuaguagagcucgaauagucuaagauuguuccacaucaggaaaaguguacaguuaucagaauuacuuacuaaugaaaaaaaggggaaaaaaagauuauuaggcugcaggguagugggaaggaacaggguagcaacucuacagugacuuggucugagaaacccuguaacuuggauccagccagggaaguacuuuucccaacaaucgguuccgcuguccugcugugaccaguaacaggggaaaaaaauaaaacuccccuaaagguaaaugauucaccucaugaacgaagggaagaauaagagaccuaaguuuauauacacagauuccaauuguaaaaucaaaccuauuuuguuuucuaaauaaacaauauuugaaaauacaacauugcagucuuguuuucuuuuauacuggcuaggauggucugguccuuuagaggagguccugaauaaaauaauaugggcuguagagagaaacgccguuugcuugauagguguuuuuguaaagguuuuacuggccuacagugucaguacauugcaaauuuaagaauguucacugacauuuuuaguagccacuuaaaaaauuuuucuaagcaaugaugucauuguauuuuacuuauaaucagaaguacaucagcccgugaauuuaguuaaagguuuuuaaugucacuuuuauuacauuuuuacugugcauucaugugcacacacacacuuuuaagcauuuuugauuuauauaucccucugcauauuuugugccuugugauguguuuaacgaaugacagugucuuuagugcauugcuacuugggguuucuacacuggaaguguaauccgaggccuuggaauuggucaaacaaaacucacuuggcaacauuuacuuagagagcacucugcgagcacucugcgagcggacaugucgauaucagcucccuccucguucccccccccaccccccaucccauguuuauuuguaauuaaaguuaagaugcuugagaauggcuuuaccauuaaucuagaaacauagaguuguuuccuggugaaugauguaugacaguuuucuuugugcuuccucugaauagagaguaguuuuuguggcauuguuacagagaacagcuuuccuguagggcucacaggcucaacuguuucaaacuccuguuguucgguaaaucugucagaagggucugcaagggaccguauuuaugaagagaguguagaguggucagucuaaaaagcuccuuaguguaguacuuugaauuuuaaauuacacacauaauucaaagguaauguaacuugccgugucggacuuuaguccauuccguuaaauggagaaaaaugacugacgugaagaaugacuuauugauucuuggugggaaaaugacuucuguaauaugggaaguaugguaaaaggaauagcuuaauuauuuagggagcacuuuucaaaaugugcuuuuacagcaguacaaauuguacguauacaaaugguaugacuagguucuuuuuuuaaaaauucuuucauaggagaaaguuaugagaaggcuuauauuauuucguugcuaaggcaaaguuuaauuuugcuuaaauuccuguaagacuaacuaagaaagguaggaggagugaugagcaguuucuuaacccuuuaagaaauaugacuuguucuaauugccuuuucuuauuuacauuauacuuaggcugguguuaggaugccguggcugccaaguuuacacagugcacuuucucucucucuuucuucuuuugguuuaugauguuuuucaguagugucauggaacucacuuaaucugauuucaucaaguaaauauaugggaaguugagaugacauauuuuuaucugacauuugaagaaauauucauaaaauagcagauaaaauauuuauuuuggccuuuucauucugaucucucuuuugacucgauguguauucuuugcuuaaggaccacagccuaauguuauuuugacugcauuucacaguguuggcggccuuucagauaaacagcauauuugugguuaauuggcugaacauguucuauaauuauaauuauauuaaaaccuuaauguucuugaacguuugcccgcgaaggccacucacgugaacuaaguuauguuucugucguuauaacugagcuggcuggcggcugccauucagcaauccaggcaggacugggaaccugggaaaacugcagagguuucuuauuauuucggucugaaaccgcuguuuggauaguuuuagaaguugaccaugaaaauugccuucugguuguaacuuggauccccagguuucaaucugugggcuaacguuucuugggauuuucagaaaggauuggcuuggcuuuuuaucaaaguuacacaacggcuguaaaaaauaaauaaaaaaaaagcaaaauuagcacuuuaucaaguuuggggcauauuuccaaggccaccagggagcagggaaagucaccaaaagaccgcuccuugaaaccaggcaagaagccaucuuugcagugagcugagaggucugauggccgccagcugagggagggaauuccccuuuugugccuucgggauugauagagaagcccaguggacuuagcaucugggaaucccagauugaucuuuucuggauauugggucaaccauaagaugguaccuuucccuguguaacaaagucagauucugugaaacaccuguuuuuuguauggcuuaugagaugaggaugauuuuuaccuuuuuuuuuuuuuuuuuucccuugagacagugucauucuauuguccaggcuggagugcaguggugcaaucucagcucauuaaccucagguuuuuuuacagaaaaaguuugccacccucugaucuacaugauguccuucaguuucugucucucaccagacugauggugccaugagggcaggggcaacuccuauccuaaggcguggcccauaguaagggguauugguuagaagaaugaaagauugaauacgucaaagugaugaguacagagcugucugucauuuucuuaucuuuggccuaacaacugaacacauuuuaugaaauuugcaaaucuguuuccaaacauguuugaauggauuuuuauggucuuuuaauuaacccaauaaaaaugguaacaacacagcaauuuuaagaaaauaacagagccaaguauuuuuuauagcuaugcaugcaauccacauuacacccacaugcaguauuucuaugguccaaauaaguaucugucggacuuagaauauuuaaauuaggauuuaguugaaagauuauguucuauaucuuuuuuuuuuaaaaaaaaggaagaaaaauaaagcucuuccuaaauuuauuuacauguuggagcaauucuggcacugcuaaauaaggcaggaaauuccauuaaguuuaaaugugcugcccuuacccuaaaguguuuggagggcuucguagaagagccaaauagauucacacagaucuuauuuguagagcugaaugugcacuucauuaaaauacuuuguaagguauucaaggaugggcuaggagggugaggauuccaaaucagaaucuucaagccagugauccaggccaaagguauucugccagagugugaggaaauuucacagccucauggagacaccuccccuccccacccuuguugaacagacucuggaaaagucaccauuucuuguugguccuuugcucuuggagcauucuuggccugaccugucaaccacuuuagccuccaagguaucugagccuuucuuucgccucucuacuuagaucauauucuuccuggauuuuggaaucaggcugggacacaagccaccuccuccuccauucuagcuguguggcuccaggcaaguggccacaccucuuugagccacuaguuaacucagcugccaaacagggauuauacauuuaccucuugguguugcaagaauuaacaaggaggauauuuguaaaucucccugggagcuggauggugcuuaauaagcaggcauuaaggguugauuaucuuugcacucucuccugccagauuuuguaacugaguccaggcaucuuuagaaacagaaauggucccugcucuucuguauccccugggauaaccuagcaucauuucgcuggguuacacauccucucuucucuccuguaugucgucccucuuucuuacggugguucuaagcucuauggaucacuugucuucuccucugagcgggaacugggcaauuggagguucuuuccccucccgugcuggugggagaauuguuuaguaggucauaaaguggaaucuccauuucagucugauccggucaauucugguaggacuucauccaagcacaaagaaaccuuuguuuucauucaagacuucccuaaaagguggcugggugcggugccucaggccuguaaucccagcacuuugagaggccgaggcuggcagaucacgaggucaggaguuccagaccagacuggccaacauggugaaacccugucucuacuaaaaauacaaaaauuagccagguguguugucacgugacuuuaaucccagcugcucaggaggcugaggcaggagaauugcuugaacccugguaggcagagguugcagugagccgaugucauaucacugcacucuagccugggcgacagagugagacucugucucagaaaaaaaaaaaaaaaaaaaaaaaaaaaaaaaaggcuuuccugaaaggugauucacaggccucuucggaucccuucguguuuagcaauuuggauuuccacacagccuugcugugccuucugcccauuuguccucugcugcuggucccugggugggacagcuccccuuucuccuugucuggguugcucagauagagccauaaggauucucccugccucaagagcugacuuccuuccacgaguuccuaaccaccuguccaguugauucuucucuggaccugccuugacaucucugugccaagcccagugccgggguugcagaugcagaggcacuggugcauauuucuugaguugaagagcuugcaacugaugagccccuuccacucagaaaaauguuguuccuggucuugccacugccuggaacccaccaacaccuccucuuuccaauauugcuggcuucuacuuguucuauaagagccauguucuacaaguucuguauugugugugagucccucucaacaaaacaauuucccuagucaucucuuauuuauacuccuugaugcagauuuccauuuuacucuuaccucauucuaucauaauuaucuauuuguguguguauguauguccccacuaggcugugaggucuguaaaaggauagucuaaauacagcuaucuauugcaaaucuuauaaugugacuccaugaugagauaguuggauauagccuuauguucccagcaggaaggaagaaaggaaaggagggagggagguaagggugagagagagacaagaaaggaaaggaggaaggaaggaugggaaggagggaagaagagaguuuggucaacauuuguugauugugaaugaacaaacuaaugaacacuaaaugaacaaaugaaugaaugaauggacaaaugaaugaauguaugagugggucaagaacaagauucggccccaaggagauacgcgacuuucuacuuuguuuucuauuuggauuucacacaaaggcucuaaggucuccugguaggccaugcucagaagucuggguuguccccugcccaggacaggcucacccuggccuguguccuagguauuguggggccgcuguaggaggauggugguuaaaucuuggaggaaauccaggagucucauguccccuuggcuucugucagaaccaguaccucucauuuauuuugaggucuuggcugaagauguaucaucuacaacccugcagaucagauguguuagagcagagagaguggcgaggauuaaucuagacugaaaugugcuaaucaagcugucucagaugccauuuucuggauagggaggaacagcaguuggcgaguuuaagagcaauauggaggaaccacuggggauucuaugcaugaucuuaggggaaguagcauuauuaucuccaacacuggcuguuuacauuaucagaauaagaaugguucuccaaggccaggugugguggcucacgccuguaauccuagcacuuuuggaggaugagguggguggaucaccugaagucaggaguucaagaccagccuggccaacauggugaaacccugucucuacuaaaauacaaaaauuagccggacaugauggcaagugccuguaaucucagcuacucaggaggcugagaugggagaaucgcuugaacccaggagauggugguugcagugagccaagaucgcaccacuggacuccggccuggguggcugagaaagacucagucuuaaaaaacaaacaaacaaacaaacaaacaaacaaacaaaaacuugucuccaaaugagcagacaccagaaucucauggagggauuuuucgaacacguagcacagggcuucgcccccagcauuuuuauuuucgaacuucuggagugcagcccaaagaucugcauuucuagcaaguucccagaugauguugaugaugaugccuguuuggguaucacauuagaugaagggcuuugcuaauuucagcugcagaguauugacucaugggguaggauuccugccaucugcagcuucuuugggucaucacuaggguagaaucuuauuuucugaguaugaaaagcaucaaaguuauuuuaguaaaaugcuuuugcugucauugcuuuaaaacuagcucuucgaagugggaaaaccaaaaguuuuauugaagcaauuuguuguaaauaugaguucuguaucacauuugggaaauuuguaaagccuuacuuugaaugucuuuuucuucacucuaucuguauuguuuggugcuuucuauauaaauuuauaaauuggauguaccgccacagaugucgguuuucugguaauaauacuuuuuuacauuaaaaaaaacuccugaaaugaaaauguaacuuagucuuauuauuguaaucuccccuugccuuuuugcauggaucauuuguuugugaacugguuauuucaggaagggcucaaagguaauuucaugguuuauagcauuuauauuggcgccuucgaugagcaaaacauauuguuuucuaauacaugaaaccaggaauucauauauauauguauauauauuauuauuauuauuuucauuuucuaaaauuacauguaguacauguauaucaacuucaagacauugagaacaaccauguacagaaauuauacucuguacacaggggaaauaugaaaguuuuguaaugcaaaaaaauaaaaaaaaaucaacauuugcaagcuuaugagaugauuuuauuuuuaaugaauccaaaugguagcagggagcugcuguuguguuugugcauuguacagcaauucauaucuaaaaauaaaguaacauauggcuuuguuauuauuuaguuuaggaauugaugcaccuaaaggaguuuugagagcucugggucucguucgguuguuguacauggcaaccaaauaagaguagcuggagcagagacuuucucuucuucagauuauuaagauuugagcaauucauuuuuuuuggaugguguuuauuaaagucaagaaaucuuuugcuuauuugcuaaugauucucuccccuuucucuucuuauauuuuugaaggcugaauugguaaaauuaucuggcccaauaaaaauauguccuggguuggaaaagagcacaaguuucuuuuucuagcccuggagugagguggcucucuggccucuggguucguuugguauccuggggagucauugacacccacacacuccuagucacaagaccuuucccucccauccagauuguguuuauuuuacggcucucgcacggagcaugcagcuguguaaaccugagaaugguuucugcacagcuuugaucuuugcauggaucaacaguugcccuuagucccugaacccuguuccauggccccauauuucuuggauuuuuccauuuucuaguaauuauggcaucauguagggagccuuccaacagcaucccccacagcuuuggguggagaauuuggaaaaaaugccuuaagucugccauuuguagaaccauauuaaguagugauuuccauuugaugccaaaaaaauaugccauuuaguuucuuccuaagaggcaaucugacaauuucgaguagacugcuggagucugacaaauuugaauguauuauggacugaauaaauguuuauugaacaaaugccauuuuuuuaacucuuaaaauguucaguucuuccaccaaacauagaugacacaacuguuggagacggagcaccggacugaugcaguguagcauuauuuuguaaucuacgaacugggagccuauggagaccuaugcaugguggaauacaaaagucaugaccugucuuuauauccuaguaugggcaauaaaacccucccuuuaauagccuuaaacaugguacaaggaaacugugcaggaguuccagggaaggugccauuuuuccauauggaguugauauggucugacuguguguccccacccaaaucucaucuugaauucuaauuguaauccccaugugcuagggggagggaccucgugggaggugauugaaucauggagaccguucccccgugcugugagugaguucucaugagaucugaugguuuugugcggggcuuuuccccacuuugcucuguacuucucuguuucuucuccuucuugccaccaggugaggaaggacauauuugcuucuccuuccaucaugaauguaaguuuucugaggccucugcagcccuguagaacugugaaucaauuaaaccucuuuccuuuauaaaccacccagucuuggguauuucuucuuagcagcaugagaagggacuaauacaggggugaucacaaacagccugcagacugggccaucuuucuuaggcaggaucucgagcuaggagaugagaagagcucuauaggcaaaaagaaugacuuggaaggccacauauggcagaguagcuaagacuuugggguuuccaguuucagauagacauggguuuguauccuggcucugccccucaaugccugugugauccuggguaguuugcuuaauccuuaugagucccgguuuucuccuguaaauugggauuaauaauagucacagcuagcugggugcaguggcucacaccuguaauccccgcaguuugggaggccgaggcgggcagaucaccugaggucaggaguucgagaccagccugaccaacauggagaaaccuugccucuacuaaaaauauaaaauuugccacgcuuaguggcacaugccuguaauuccagcuacuuaggaggcugaggcaggagaaucgcuuaaaccugggaggcggagguuguggugagccaagaucgcaccauugcacuccagccugggcaacaagagcgaaacucugucucaaaaaaaaaaaaaaaaaauuauguccuucuagauugugaggauuaagcaagaccaugcauuuacauuguuuaacacugucccugagacauaguaaggccucaguaacuguuagcucucuuauugcuaccggacaaguguucuuauuuucccuuuucuucuucuuccuuuuccuguuccuugcccuuccucuuucgaagaaaguuuacgccaaaaaggaugagcuggguugcagccagcauucugguuucacaggagccuaggagauacauggagaauauucugaggcuagguuaaauaguuugucuccaguguggguguuagucauauucuuaucaguaucugaagaacccagaagacugacucucagaacggaaaacucuuggcuagaggauuccgaaagcuagcgugaaguggaggcuauuacucagugggugccguaacaugucugugucaccuggcaccuuuuuauucucuaaucucaggagugagugcuuccuccugccgugccuggccacuucucaccuucagagucuuugguaugcauaaauucuucaucacuucaguagagugaacccugauuaccuacauuuauuaaugaaaacaaccaagaauaguugagcccaaaaguacaaaucaaugugcugaaucaguuuaugaugucucccuaauuucugcacaucuguugagcugugauuucaaauuccauuccauuucuuuucuuuucuuuucuuuuuuuuuuuuuuggagacagugucuugcucugucacccagccuggagugcaguggcgagauuggcaagaucguagcucacugcagccuccacuuccuaagcucaagugauccucccaccucagccucccaaguagcugggacuacaagguugugccaccaugcccgccuaauuuuuuguauauuuaguagagaugggguuuugccauguugcccaggcuguucucgaacuccugggcucaaguguugugcccuguuuggccucccaaagugcugggauuacaggugucaguuaccgcacuggccuggaaauccuauuucuugucaagcaggacaucaaaguugagaucuaagaauuuggacuaaaauuuggggcagguuguuuccacuacuguguauugagagauggcagggaccaucuugccgaguccaagagauugugaagucuaaaaggcuuggccgcaguguugguucaucuguaacagcugccuacaagggaaucuuugagaaauacagauugcugcaucuuauaagaaggacagugcuuaaaacagaaagaauugaguagaaauuaagacauagcuugauuuuuuuccaacagaaucaugaagucuguucaauuuucuuuuuaaaaaguaauuuaaucuucuagaagauaucuacguuuauucaauaauuuccuaagguagucuucaaaaccuaggagccuaggagauacauggagaauauucugaggcuagguuaaauaguuugucuccaauauggguguuagucauauugucauccguaucugaagaacccagaagagugacccucggaaaggaaaauucuuggcuagaggauuccgaaagcuagcgugaaguggaggccguuacucagugggugccauaacaugucugugucaccugccaccuuuuuauucucuaaucucaggagugagugauuccuccugccaugccuguccucccucccucccuccuucccucuccccucucccuucuccccucuucucuuuccccugucuccuucucucccucccuucccucucuuccuuucgcaucugacaucuccaaauaguuuuucaugcaauggcauuacuaauggcuugacuuuuucgggaaaugauucauuacuuuaugauuucaauucaguaaccauuuucagcuaugccauaaauuuaaauccuuuaccaucaagauaacguuuuuuucuccugucacugaaauauuaugauuggaaacuauuuuuaaaaguugacucuguuugggacagcucuuagggauuuguccuuuauaccagcauauaacuuguagguugucagugucuccaggggccauauguucaccaccuagacucaacaguugcuaauguuuugccauguuuugucaguucaucuaucuguccaucucuuuguccauccauccaacuacccacuuacccauccauccauacauuuauccauccaucuacccacccauccauccauccauccauccaugcauccauccauccauccaucauccauccaugcauguaaguugcagacaucaacaaacuuuacccuuaaggacuuuggcuggcaucuccuaaaacuaaaggcauugcuguacguaaucacaacuaucaucauuaucaugucuaugaaauugguaauaauuugcuaacauaaaauaauaccuaguccauaacaagauuuacugaauuauucacaaauugucuuuuauagcuuuuuguuuucaaucaggcuguaaaguucacacauuacauuugguauuguaucuuauuagucuguuuauuaaagaguuuuuuucagggaucaggguuagagggaaggcuccuuucuggauacuguguauacuacuaauuuucuuuaucggcuaccaagguuuucuuuauuuuuuucauacuuuucuuucauugaggaaacuuauuguuuuguacauuuuguuguaccuuuaugaaucugguuuugacuucuggcccagcuaagaagcugguuuccuuuggugaaacaugggagaagagggaggaaaaaucuguuaauuagaauugugggcgugcacucuguuuaucucuaacagaauaggcuucccacggcucugagcuggaaaggaagauucaagucucagguuaaaaaacaaacccuccaagaccucagggcuguuugccugugauuagagucuaagaaagacugagaauuggaaaucaggacugucucuggucacugaugguucaacuacagcacagaugcacuggguaacagacacaccgccaggccucaggauuacguuaccuaggguuaggacugagccuuucuuccaccuucuugggguuggagggcaggaauuuaacauaucuuagaucacagaguaaggccucuucuacccauaaguuugguuuauacaucaaaguaacauucuaaaauuagaugaggguguuuuuuuuuuuuuucuuuuugagacagggucucacucuguugcccaggcuggagugcgauggcacaaucucagcugauuguaaccuccaccucccggguucaagcgauucuccugccucagccucucuagcagcugggacuacaggcgccugccaccaugcccggcuaacuuuuguauuuuuaguagagaagggguaucgccauguuggccaggcuggucucgaacuccugaccucaggugaucugccugccuuggccucccaaagugcugggguuacagaugugagccacugugcccggccuuagaugagguuuguagauguguuuuucauauucccaaagccaugaaauuugacagguaaauauaucaguuauaaaaguuuuaggauuaauuaucaacuaacucccagaaguugccucagccucucuuuuucagccuugucuugccccagcccagagacaagccacagcuauagguuuuauuucugaaggagaaaacucaguggaccauuccacugccucaggagauauugccuaccugcagacauguuuugucuuauccacacaugauguaaaaacaaaauaaaaaugcugagagaaaugccaauucagagguuucauauaaaaauauagcuuucccauuagacuugaaaauuggaagaggagguaacaauuggccagugcugaguagagggcauguggucucuacuuugccacaaucuccaccauaccuuauugucucccuucucagucgaagcagcuuuacacacuccugcuacuugccaagacacuguacacauuuaaguuugcuaccuguuacuuggcauaucucuugguuccuaagaguuuuagguauuaugcaauuugccagcucccucagccccuuuccuggcuccaaaccuuuggcuuugguuugauguuacuggguugcugcaggaaauuucccuguggaccucacuacuuuaucaacuguaauggucuuguugaagacaaggcuuagaacaucaucagacccagagccuuucucagaggaccugggagaacucuccauauggauuuucauuugggaagauagaugcucuuauuggaacagcugguuuucccuuuaaaacagggaguccagcagcuucuaggaugcuuagaaucagaauuguugcucacuuuuuaagguauagaguauuugucuuauucuuaacuacauuuuauaucuuugcccuuuuuuccccuacuuuaaauaaaaucuaucucuaauuuauguuacuuaagcaaugacaaauucuuuuucugauagacaaaguaaaguauaaauaaauaagacauccaaguaauaaucagaaguauuuuuuauguuggucucauuguggucuuuuuaaucccaggccugaugcgcuuuagguaccagccuugguugaagaggagcuugaacagccuacacagacaugaaacuugagcaacugagcucauggacguugcuuuuaaucaggauccagaacuagggaguugagugagcuuggauuugagcuccacuuuucaaauuuucaccaccugugcucuuucguuuuuguuuuuuguuuuuguuuguugguugguuuuuuguuuuuuugagaugguguuucgcucucguugcccagucuggagugcaauggcacaaucucggcucacugcaaccuccaccucccgguuucaagcgauucucaugccucagacuccugaguagcugggauuacaggcaugcgccaccaugcccagcuaauuguguauuuuuaguagagacgggauuucugcauguuggucaggcuggccucaaacucccgaccugagaugauucacuuggccuuggccucccaaagugcugggauuacaggugugagccaccgugcccggccagacccgugcucuuucucccaccacugcccugugccaaccaccacccccacuccuauucuggaaagagccaagccgucagcuauugcuuuugaaucuauacgcaauucuagcagcuucuuuuagagcccuuuuaaauuagcaugaaauaguuuuacuagcccugagguuucagccaaggagcuuuaaaggagccagcccuuuguuuacuuauuuuuccucuucugaacauuuggaaacauagcuucggugcuccuucuccaagaaaccugagucaugaccuccccaaaguguuuccuucccguggccucuucucccgaucagcuguuuguuaucugagggauucguuaauaaccaggacaucugauucucaucauuacucauccucugcucacucuccuuucuaaugcauaggccuuuagccuuuuacuuucuaccuuuuugaaugcuauacuuuuuuguaaaauuuuaauuagguuaaugcauugacauuguucaacauucaaacgauggaaagggugaguguggagguuugguuuccccacuuuuuccagccaugcuguugccuucugcagaggcuucuagaauuuucagaugaaugagaauccuuucagaaauagucucugcaaacuccagcacacccauagugcuagggugggucuuaguaaaaugucugcaggguaagcacacuguuuugcacuccacacaauucacuucacaauauuucauagagacuuuuucauauuaauauauaaagagauauauacgcgugcugcuucacgauaauccauugcagagcuggucuguaauuuauucaagcauucuuuguugauggauguuaggguuguauccauuauuuugcuauuaugaacaacaccauaaugggcaaccuuguacacauuuccugucaacauguaucacugaauggaaaggaucuauuccuagaaaggauccauuccuagaagaggaauucuguacaauauggccaacuuucucucuguugagguugaaccauuugacacauuucgcuagcauugggaaaauccccauuuuccucacuauccauuuuucuuccucucuuuccuuccucuuuucccuucuuccucuuuuuuuuucuuuucuuuccuucccuuuuuccuuuucuuuccuucuuuccuugccauuuaaaacauacugauaacuuggcagcacagggcagugauuaaacucaggcacucaccccacccuaccugggaaucugaauucugucuuuucugcugcuguggauucucaguccccaaguuguguaaaucaaagcuucuccugccacacuaguguguauuaggccaggacuucauagugugauucaaaucaccaacugaauuuuuuuuuccuuuccuuccccuuucugggggacuacguuuuucauggagaccggggcccuccagcugcugugaugauccucccuugccagggaggugcuguuaauagcaaaugccaagugagcugguguucugucccuccggccuccuugcucacaauagccaggaggaaaaagccauguaaccucuggaugagucccuuggccauuuagaagugaaaugaacauccaagaagaagcauagacaauguggaggaagaacucuuccaaaugauggcagggauauuuggaaucuuucccccugaguucccucuggaaguuaaagcccagaucccgugaacugauuaaaaagccccagaccauucccguuccagucaucuugaaacugagcaagaccgugucauccauggagcuugaacauaggagcacuuuaaaaaaaaaaagaaugaaaagccccuuucuuguuuugguaaugauuuaaugacagaaagucacccacccaccacuuggguaccacgcagcccacauuaaacaauuagcccuugacaguggauaguucaaguuaguuugaaaugagaaauugccggugaccugaaacccaucauuauuaaccuuguggcacaacauugccauaaccaguagccaacucucauuuuuucuuuuucuuuuuuuugguuggaagaaaggcucauugaggaaaguuggcucaguucuuuuuugagugaaguggucagaccaccaagaauuacuuuccuuugauugggaacagguucuaauacagauguccuuuacaugggcaauccacuuuucucauugauuccacaaucaauucgagcuguguuuauauauagacaccugcccacagagaccauguggagaagcauuugcgucucgcugccugucuuccaaaggauuugccuucuaguaauucauguuuuuauagcuuaacuacauuuauagugaacggguggcuucuucauccaaagaaagaacaaaugacaaaaagaaaaauuuugaugauuugggaaccgcauuuauggaauaauaacauucaugauaccucuggauaaugacaauaauuacaguauacgauucuagaagggugagucuagcuguucccaguguguuuccauggguuguuauguguuacuggucaggcgaucagggauuugcugaagauuuucuuucccauguggcaguagauauuucagaacccugcaucaugguguccacagaaguccccagaguuguaugagaguucaucugggcaccuuucccaaaggcaggcccccugugcagcuucaacuauucacucuauuuauaauguuguuccuggauauugggcuugcuuccacuuguggccaggagaggauauuucuuacuccagaucaaagaguugagacauugccuucccacaauucccagugagcccaacuccuuaccacaauucccaccccaugccuuccccaaauuccugaugagcccuaugccuucccacaauucccugugaauuuugcuccuucccacaaccccagugagccccacucugucccauaauucccuguaaaucucacuccuucccacaauccccacugagucccauuccuucccacaauucccuguaaaucucacuccuucccacaauccccacugagccccacuccuucccacaauucccagugaaccccacuuguguagugugucugugaguagucugcccacucuccuuaugacagguuuccaguauuaucuguuucauaacccauuuccaaccuucuggguuuuuuccuucaacguuuccugugacaguucuccauuauaucuuuguuagauaauaguuagcaacccauuaauaacuuccaacuuuuugagccucuaccauaucuuguuuucacugggauuucuacaccguggcuacuuugugggaccugacuuaucaagaacuuaagcagcaucuguuagaaaagguauuuuuuuuaugaaguaaguagggaacuaacuaccuguucacugcugcccguucauugcuagcacaaugccaagugucaaauaaauguuucuugaacaagugaauagaguacgcuucuaggcuucuggaaacggugaauguugcuuuauguggcaaaaagggacuuuggagaugugaucaaguucaggaucuugaaauggggagaugaaccugaauuaccgaagugggcccuaaguacaauuauaaguguucuuaugagagggaggcagaggggacugugacuacgaaagaggaggaaacagggagaagaggugaagcaggugugaggcaacaaucugguggcuucuagccccugaaagaggugagaaauggauuaucauuuggaggauucagaaggaaccagcugugcugacaccuugauuuuuuuaacccagugagguugauuuugggcuuuugacguccagaaugauaagagaauaaauguguuguuuuaagaccuaagaucaugguuauuuguuagagcagugaucagaaacucauacaaguaugaaugcuaagaguaaaggcaccugccucccacauacuggacccuuaauauuccuuuucaugggagguuuugcagauugcugcccuccuugcucuccuuacucuucuccuuuuacugaaaagauauuuacuagaugucuagcauguuaaagacuguaccuuaaaaaaaaaucacacucuaauuuagcacaguuucaauugugguuaagcaccaugccauucacacuucagaaccaagcucagauccaugugugacacucuggaauguggcagcugauggaggaagggggcugaaguugaaucugcaguaguugaguuaaccuucccauggugccugcacuagcagggacuggacugagaccccagcuuucccagucaggccuucauuuuucucucauggugagagcuuuggaaauaggcagugcagugugggaguccuuccccuagcauguuaguggccagcaccaugccacacagccacccagagcugcaagagagucugcagaggugauugccccuugcuaggugaguguaaaccaaaaauaaauucuaagcuccccaagcaacugaauggaucccugccucugggccaaggggauuccgaaauaaaccugaaaaacuaguucaggcagugaugggaagaggggguuggauaugacucauuauacccuucuuuuuuuggaauucagucacaacugaacagcauuagcauuaaaacagauccuaaggcugacaaaacagacucuuuauagcaauaagauaccaaauuucaacccuacucuaguauaggaucacuuugcagauagcaggcauggaaagaaaucaaauuauuuuaccccaaaauauauuucucugguauauuucgaaauggcccugcaaagcuguuucuugucuacauucuguagagaacauccuucccuuuccaggucuuuuccugauccaggagagauucacuaggagucuggcaccuuuuuaguuuugauaagagauauuuaccauuuauucucucugaggccuauuuccuggaggcuucaucugcaucauaagaaccuuggucuuuuuguggacuuaucuuaacccagauaguccuuucuacugaugccagguguuuagcuaauaacacuuuuaaccaauugccaaucagaagauccuugaaucuaccugauacgguuuggccgcaucgccacccaaaaucagacaguccuaucuguugaucucggguguuuagcuaauaacuccuuuaaccaauuuccaaucacagaaugcuugaauccaugugauaugguuuggcuacauccccacccaaaaucaguccuuucuauugaucucagguguuuaguuaauaacucuuguaaccaauuaccaaucugaaaauccuugaauccaccugauaugguuuggcugcauccccaccccaaaucucaucuugaauuguaauccccacaaucccgacaugucaagggagagaccagguggauguaauugaaucauauacucccgauagugaguucucacgugauccgaugguuauaaauaaguguuugguaguuucucugcguucauucugcuuccugccgcuuugugaaccuggugcuuugcuuccacucugcccugauuauaaguuucuugaggccuccccagccaugcugaacugugaguaaauuaaacaucuugccuuuauaaauuacccaguuucaggcaguucuugguagcaaugugagaaugggcuaauauaccacguaugacuuggaagcccucauccccaucacuuugaguuguccuuccuuuauggaccaaaccaauguacuccuuacauauauugauagaagugugccuguaacuuuuuuccccuaaaguguauaaaaucaagguguaacccagccaccuugggcacacguucccaggaccccuugagacugucuuaggcuuuguucacucuuguuugggucgggaauaaacuucuuuaaauauuuuagaguuucacucuuucaaucaacguacgugacuacccagaauuaaacuggaaugcuguuaauaagagaaaugaaaggaugaugggagaugugcacccagcagugucugucuugugguccugaagucuaacucuaauccuggcuccacuaccuggaccaugacagguuguuuaauuguucuaguuagaguguucuccuauguaaauagggauaauaauuggauguauggcaggauuugggggaggauuaaauuagguuauaugcgugaaguucguagagccagggucugggcauuaauacgcauuuaguuacugucgcuccugugaucugcacaauuauugucauuaucuucccuuccuccuccuucccccuccuucccccucucuuuuuccuuuucuuucuaucaucauccauagcucucuugccccauuguuuuaaacccaucuguuuuuguugcugguaacuguauccaaaaguaauacagaauuuuccguaagaacauuuauuguguuuccuucuacccacgaauuuucuuaugcuacacacacaacccacugaaauuucaccucuauuguauguggcuuuucuagaaacgugugcuucugggcuuugucucacaccuccuggccaguguuuggcaugugcucacacaugcacgcacacacagccugcacuauguuuguugacugaaugaauuaauauuucacagaauaacaaacacaugcugauuauacuccuugggaagcuaauuuguuuucagcucugagagcaaggccaaaucaccagauugaugccuuuggcuguguaucuaaaggacgugccauugcagcuaaguggaccugaauguacaguaagacuuaguggucaccagaaugcaugccaccccggugcuucugcaugcaaagggugcgggccaugugccagucacaguggaaaaggcaugcuucgugucagcacauuuggcaucucucugggaucggggauuuauaccccaaaaccuugcucuagagauuuggcuuccauuagcaaggguaaggcuuguaagaaaggaguuuuacucaccuuugcuugcucucacagcugugucagcccauuuucaucucuuuucaauguuuuaagcccugagagaacccaguucaauucccagcaagaaaugagccucuguaacgcagccccagacccaccuucgaggguaggggcacccuuguugucacgauguacaggagccaggcuuggcaucggaguggaugcuugggaagccccagagaaauagacgagugagugcaagagccagcugccugcguggcuuagaggaagauuucaaacaccuagugcacugaaagucugacuuaauuugugauuugugaauagucucccagaagcuaugggguacagaugugggacuugugaaaaauaccagacauccuguggguuaaagaaaaagaaaggggggcggugggugaagugugagcaauuucuggcagcuuugugggcauuuauuaugucuagguggcacagugugguuggacugguugguuuccuaucaguugcauucccuguaugucuucagccaauuuuuuugguaauccaaggccugauguauauaaacaaauuccuuucuugaucaucuaagcaaugaacacuuaacagagucaagcuuggagaauucaguuccuaccacaagguccggaauggaggauuuauaacugggagacagaagguaugcugaaagguacucaaacugucacuuccuucacccccaggagcacugaagcagacacugauuccucugcaguuguugggcuuuugagcuacuucccuccuggggagaugcguguuaacuguuuaaugacuggcaaugccguaacagugagcaagcaaugugaccuuacaaauacaugugcagaaaugcagaugagugggccuaaagaauccagacucaacuuacuucuagugguaauggcuguaggagagauggggaguaggagaagaaaagccaaaggcagacuuuagucugguuuauaaugcuuuaauauuuuuuugaaggaagaaaaauguucauuacuuaacguaauaauuauuuuuaaaaagcagccuggcggggggguauucauuuuucuguggcugccauaacaaaguucuucaaacuuagugucuugagacaagacauuuauuuucuuaaaguucuggaggucagaggucugacacaggccucccugggcuaaaauccaggugucuucagagcuguguucuuuuggauacuguagaggagaauacauuuccuggccuuuuccacguuacagagacugcccauguuccucgauccauggcuccuuuucggucaccuuccagccagcaacauugggcugacuccuucaauggccaugucucugguucuuugucuuuugccuccuccucuuacuuuuaaggacccuugugauuucauuggucucagcuggauagcuaucaagggucacuuuaaggucagcugacuagcaaaccuaauucuaucugcaaccuuaauucauauaaccuggcguagucucgauuuuauuuuaauuuuuuaauugaauucagcuuuacaguaucuuuuguaggggguaauuuuagcuucuuucuccguugaaaacuucaaguaaggaaacacuuauauugcuagugaguggccagcuggaguuguaggucuaauucuuuuuuuuuuuuuaagacggaguugugcucuugucaccuaggcuggagugcaauggcaugauuucugcucacugcaaccuccaccuccuguguucaagcaguucugccucagccuccugaguagcugggauuacaggugccugccaccaugcccagcuaacuuuugaauuuuuaguagagaugggguuucaccacguuggcuaggcuggugucgaacuccugaccugaggugauccaccuaccuuggccucccaaagugcugagauuacaggcaugagccacugugccuggcugguuguaggccuaauucuagcaaucucagcaacuguaggauuucucugcauuggaggaagcaagacugaaggucgucuggcuuuauggacaaugugcuuagaaguucaugccauaccuuagguccagucuugugacugaaccaaccagacaggccuaggcucugcccuaaguggucagccuccgaggugguagcacgcagggccucacuucccacugccucugucuaugggcaugugcugugugccauucucuccccuuaucaguggguucccagcugccugguguacaggaggguuaaguagauaccuguugagugauugugaauguuuucauucacgggggcagauuuguguccuacuaacaccagacauguccuguuuucagauuacuucuuuuucaacaucugaguaccuauaacaucuaaagaauaacaggaaaauccaccuggguggccaaagucaauguaaugggcagaaagggcaugugguagacuuggaaaucagacaucuuagacuccaacacagggcucuuccacuugcuagccauggaaccucagacugggauccuugacuuccuuaucuauaaaauauggcuuauaacucacccuguauuauagaucugcugggaacaugauagaacgucugaacagugcuggcuuauagcaaguguucagagauguguuucguuguuuuucuuuuuucuuuuuuugagauggaguuucacucuuguugcccaggcuggaguacagugguacgaucuuagcucaccacaagcucugccucccguuuaaagcaauucuccugccuuggccccuggaguagcugagauuacaggcaugugccaccacacccagcuaauuuuuguguuuuuaguagagacgggguuucuccauguuggucaggcuggccucaaacuccugaccucaggugaucugccugccuuggccucccaagguguugggauuacgggcaugagccacugcgucaggccuauuguuuuuccuacguaccgugauugcuugcuuucuucucugucgaugucccugccaucuaaaugcugaguccccuugucuacauuuugaggcucuucuauuauggaagagggcuagagaggccaucagaauuugguuucacuagccuuugauccuuccuguuuaaggagcucagcauuuagcuucacuucccugucauucaucagaauucauucucagauuggaauuguccagucuuagagugauuuuuguccccagugacacuucccuuauauccgugcugacacagguucaggagaccaggucgagucgaaauccuggcuguuccgcuuucuaacaagcugcuucaucuuucugugccucacacaucuauaaaauggagcugggcaucugucuccuucaguuauggugagaauuaaaauaaaaaacacaaagcacuucuaagaaaguacaggagaggccgggcacgauggcugacgccuggaaucccagcacuuugggaggcagaggcuggcagaucacgaggucaggagauggagaccauccuggcuaacacagugaaaccccgucucuacuaaaaauacaaaaaaaauuagccaggcaugguggugggccuguagucucagcuacucgggaggcugaggcaggagaauggugugaacccaggacgcagagguugcagugagccgagaucgagccacugcacuccagccugagcaacagagugagacucugucucaaaaaaaaaaaaaaaaaaguacaggacauacguaggaccccugaacauuuaucccccugcugccaguacguuacagcaaccaccaaguccaccucuaucaggauggugccaauuugugggguuuuuuuuuuuuuuugagucggaguuuugcucuugucgcccaggcuggaguguaauggcgugauacuggcucacugcaaccucuaccuccuggguucaagcgauucuucugccucagcccccugaguagcugggacuacaggcacaccccacccugcagggguuuuuuuuuuuuguuuuuuuuuuuuuuuuuuuucuguauuuucaguagagacaggguuucuucauguuggccugguuggucucaauguccugaccuuaggcaagccacccgccuuggccucccaaagugcugggauuacaggcaugagccaucacgccuggugaauggugucauuuugauguacugagccaucucaguuuuuccagcaaccuucccucaccuuuguggucagcuagaaggucaguuaacacaugggaugggaauucuugccaauguccuucguaaaagaagaacuucuccuucacucacauguccugauacuuccucagcauuucauucuagccuuucugucuccauccaccaucuaucaaucaucuaucaucuagcuaucuaucgauuucucuuuuuuggcuuuaauuuugucacuuuuucuucugucugcuauagaaauagcaaauuuucuuauguaagaaaacucugaacgcgaggccaaaguagaauuuucccugaaacagcuaccuuuuccuugaaauuguucuauaucuaaaaucacuaggugaggaguaauagaaauguagacaugagaagugaaacuguuuuuuuuccuuguaaaagcuucauugugcccuuuagaggauaacucuguaguuugauaugauaaaaauaauuauaugauuaugcugagugagguggcucaagccuguaaucccagcacuuggggaggccaaggccggcggaucacuugagguuaggaguucgagaccagcccggccaacauggugagacccccaucucugcuacagauauaaaaauuggcugggcaugguggggugcagcuguaaucccagcugcucaggaggcugaggcaggcgaaucgcuugaacccgggaagcagagguuguagugagcugagaucaugccacuguacuccagccugggugacagagcaagacugucucaaaaaagaauaaaaaugaauaaaaauuaugugauuagagaggggaaaacaaucauuucuugugcgcuaaugccacucagcaggugcuuacacugucugguucauccuuacaaugacuccauguuaucgccauuuucagauggguaacucagguagaaauaugauuccauuaguuuaaaaaaaaauacauagaagauaagaaaaaucaccaaaaauucccagccacaguagauguaucuguauuuaacuacucuccucguguugaauauuuaucagguuucucguuuucuuuuguuuuuguuguaaguggcacugcaggccaguugcggucacucaaaccuguaaucccagcacuuugggaggcugaggugggcggaucacuugaggucaggaguuuaagauuagccuggcccacauggugaaacccugucucuacugaaaauaaaaaaaaaaucaggcauguuagcaugcaccuguggucccagcuacuugggaggcugggucaggagaaucgccuugaaccugggagguggagguugcauucagucgagaccaugcuaguguacuccagucugggcaacagagccacaucuccaaaaagguggcacugcagcaaacagcauccacaugugugcacagaauauuguucuguuguguaccucagauggcuuuguuagguuagauucccugaaguggaauggccagggaauuuaaaaaggguuuugcucuugucaccugggcuggggugcaauggcgugaucuuggcucacugcaaccuccgaccccccuggguucaagcgauucuccugccucaggcuccugaguagcugggauuacaggugccugccacuaugccuggguaauuuugguauuuuuaauagagaugugguuuugcgguguuggccaggcuguucuaaaacuccuggccucagguguucugcccgucucggccucccaaagugcugggauuauaggccugagccacggugccuggccaagucuguuuuuuaaaucuggaaaaugggacuuguuaacuucuguauugucuuuucugcugcuuuauccaacuuugcaaucuauaagcuucuguuacuggaaaauggugaugguaaaguaauugcuuucuuauguuccaucacagaggguagacugcuagcucuaguauuuuucaaugcugcuuuuuaagugauagauguauaccauucaguaccaacccugcacccugggacaugccuccuugcugaaacuaccauuuaucuuugugaauucauuauucguuuuuccaacaaacuuuuauugaacaucuaauaagaccuggacauuuggcugaaugcuggaagugcaaagaugaaggaaaguugcuuuuuggaaggauauuagaauccaaaggugaagccugcacaguaaguaggccaguggugggauaagggauccauuggcccaggaaauuggagggacuuggagaaggaccaucucacccguccaaagaauggaggaguaagggaaggcuucuggaaagaaguuguguugaggcuguguuuggaaaggugaauaggaguuaggccagugaggaauggggugaacaacugcaggaacuugagugauacuuuggggugaauucucucucucucucugucugucucucucugucucuguuucugucucucucacucacauuuuagguaaagcaguguuucuuccccaggggugauuguguuuguuacagugugauggagacuggauacugcaucuagcagauagaugcugucaaucauccuacaaugugcaggaccgugcccacacaaagaaugacccguccccaaaugucaacaguauucaggcugagaaaccauguacuaaggcacaggacaagcaucggguuggauaauggcagagaaaaguaccuuaccuccuuccagaaccugagagugugugacugugagugugugugugugugcacacacuugcguaaagugagaaaaaucugguguuuuuucgaagucugccucguuuaggcucuggacuccugcucucuguugacucuguccagagaguaagcgacucagcaggugugccuccccaugggcccccuucacgguguccucaccuugauuuauuagagcauuuuauucccccaacaguguuuaugacauccaaggacuugguggaaccaugaggaaaugagaguggacagugagacuacuaucauucauuuucacuccccguaaacaucuucuguuucuguuuuagaagacauugcuaauccccucaugcacuggcuuugcgaauuucuuuuucagccuggguuugaaagcaaagugguagugacuuuuuccugauagcugcugaaaagguuccacaguauuuggaccgcugccugcuucuacccuggagcacaaaagauccaggcguagaaauugguucuaacaauauccuuuuagagaacaccaaggggaugugagucacuuucccuuugauuuaaaggcacugcgucccucaaauucagaguuagagggugacauguaguugaucuuuacuucccgggggcagaggaccauaauuaaauggcuguggaaacccagaagcagccuacagaaacucuuaggagcccuccgucugggaggaauuuuuuuuuuuuuuuuugguauaucuguguuuacaguucuagaaaaguguugguuuugagggcaauggagacaggaaugaggagaaaauguauaaaggagagguugcugugagccgagauugcgucacugcacuucagccugggcgacaagagcgcaauucugucaaaaauaauauuauucuguuguuuccuaauuguugauuugugguccauauauuugguuccuuaacuaaauuggaguucuuaaaacaaauguuaagaacacaacauuuaggcacacaguacuuggauuccaguagcuuuggauaaauuaauaaaauccuuccauuuucucaguuguagaaugggaauaguacccaccuuauaggcuugcuguggggaguaagugggauaauaaauguuaagugcuuuuagcuguacuguacauacauaauuucuguaaguacuggcuauuuuaaaaauuauuuuaacacuauucugauauaggaaguuaaaaaauagcacagaggggaucccugugauuuuuacucacuuuucuacaagcaugacuccuuauauaacuacaguacaggauccaaaccaggaaacaugccuggguacaaugugaguguauaauuccagguagguaaaauaauggcccuuauuaggaugucugcguccuaauccgcggaaacuauggauaugcuuuguuacauggaagaggaaaauuaagauugcagaugaaauucaaguuacugauccugcgaaguuaaaaucaggagauuacccaggguuaucugguugggcacaguguaauugccaggauuccuaaaagggggagagagagucggaugagucaggcagugagauggcagcaugagaaggacaccgccacacauugcuggcuuugaaaauggagggaggcgggcaugagccacagaaaguaggcagccucuagaagguggaaaaggcaaugagauggauucuaccguagagcuaccagaagggaacacaccuugcugaugucguuuuacuauuuucuuauuuauuuuugagacaggguuuugcucucgcccaagcuggagugcaguggcgcuaucauggcucacugcgauccucccaccucaaccuccuaaguagcugggacuacaguguguaccaucacgcccggcuaacuuuuuuguauuuuuaguagaggugggguuucaucauguugcccaggcuggucucaaaccccugggcucaagcgguccucccuccuuggccucccaaucugcugagauuacaggacccugcugaugucuuaaucuuagccccuucagaucccaguuggucuucugacuccagagcuauaaaagaauaaauguguguuauuucaagccgugaauuucuuauuaaugugucacauagcaauggaaaaauaaacguucuaugccauuuuuaucacaugcguagguucauuuaaccaccgccacuacuaaaauacaggacuguuccaucugcaccgaggucucucugugcuaccccuugaagucacacuugccacccuccgcccuuagccuuucuuucagccugugaggaagcaaaacuuuuacucuucaggcaucaccucacgcgucuuuucugccugggaggcacuuuuuccaguuuuccuggcgaaauagucaucuuuuaaguucucugacaaccccucucugagcaucuaaucccaaucagaauucccuccuaauguaaacucucauuauaucuuuuaacuuuauuucuuagcacuuaucaugcuguauggauaaugguauauuugggugagaguauuuguuucucuuucucccuaaguaggcuggaaacugcaugagggcaaaaacuuagcuuuacucaauguuuucucagcuucauguacgugacuguauacagagucugagccgagaaaaccuuccuugcauguacgagcaaaugagaguauucaagguacagaacugaaauuuucucuggguuuuuaaguggaagaguacacaagcauuauaagcaauuuuaccugcauuuacucaacagacuuuuguuuuuuauccccuucgguguagguugucauacuaaauugguucagauucuguaucuggggguaguuagacuucugugaacuccaaguagacgguugaacaugacugaacuugcacaguggacacauugugcauuuguuuuuaagucccuagcuguuuccagaaauaguuugguuaauucauacugauaaaauaaauccccguaagagcauuauuccccaaagugggcuuccuuugccaaaccuaauuaucuggagaagguauugaagaagucaacuuaccucuuggccaaaugcuuucuagaauuauucaaccaaagacagcaggcugcaccuaggggaagccaaacaucuggaugaagaaugaaauauccagauguuuucaaguaucuggauguuucuaaccaucuguuucucuugguuauugacaaaugauccagcuguuuugcagaagaugguauaccuugccuaacagaagagagaaguaacauucuuagaaaacuuugacaucaucucaucuguacuaacacaggauuucugucuuuaauugaagccaugacuugaucacaaaaaugaaaauagcuucauguguuucugaagcuguugucuugcuuugggcgccagacugcacaggauuuuagguuaauugucuuguuuacaauuagagucugcauuguuuguagcuugauucuauuuauaauguacucacaccuuaaccaauagccucacagauggcauaugagaauacucauacucagugcugcuaaaaacagccugcugccugaacaccagagugucuuuuaaagcguagaaaaguuggguacauaaaauuucuguugcaaaaaggaauguauaggccuuaauugaaaauguaucuuucuggaacaggaguuuuagaagcugaguaccacccacucccuugcuccacaauucucuuuuguuuaaggcaacacguagguucuuaguuuuuuaaauauauauauauacguauauauauacguauauauaugcguauauauauacguauauaugcguauauauauacguauauaugcguauauauauacguauauaugcguauauauauacguauauauacguauauauauauguguguauauauauauauaaaaauauauuuaaauaauguuaaggcuagaguagaaugacaucaugggaaggcuuauugaaacuuggaguggauucguagucugccacgagaauccuugucugauguuuguggguguguaggacugaauuugaaguccuuaaauggauguccuaacagugaauaaagacguggggcuugaauuuauguauuaucuuauuacucugucauuuucuugagugguacaccagagugcauggaaaaguaaaugauuggaagccgcgugguaguuaagggugaugauguaggagugagaacacaggcuuggugccuggcgucagcacacacaucacaggcccucccugucaguggcugucgucuguuaguguuuccagcacagcucuaaagagcgacgcuuggaggcuggggagagggggauggagaggcauaugauucuguugacauuuagugacaugcgcucuucccaaccaaacagaugcaaauggauuuuaguugugagugguuguuuaacaccugcauaagugacagaccugcagagacagguuguggauggaacgcaaauucaaaucagugcaugagaacagcagcuaaaguggacagacccaaauguuuugccuaaauauuuggcuccuaguuguacaaaaagccaaaugguuucaauuucauccuauauaaaccagaugauuguguauuuacuucucacuugcccugccagggggaugguugguggggggaagacaaggacaaacaauucgaaagagcaaaugagccaaaauccaucuggauuuuguuaaugcugauuauauaguuucuucuguuguuuuuaaugucuuccaagccuucuguguauuagccagcauuaaggggaaaaaaugacauuuugacuuugacucccuuuguaauguaaugcauuguuauguauuucugaaguuuuucuuaaggaaauaguauaugauaauaaugacuagcacucacugaguguucgugaucgccaggaucaggccaaagguuuucacgcuugugccuuuuuaaacuucucaacaacccagugagauagauguuauuagcccaauuuaaggauggggaaaguggggauucacagaugaaguaacuugccccuagcaucguacagucagugagugugagagguacaauucaaacccagguagaccugaauuaaaucuucugaagcaacucuucaucaccagguguggcuaccuccaaugauuacuuuguuuuuaugauuaucaacaaaguuacucuguggagcaggggcaggcaaacauuuucuguaagggagagacaguauuuuaugcuuugcaguacagucuuuugcaacuguuccacuuugucaccacagcacaggagcagccauggacgcuacguaagaaaaugaguaugggaguguuucaauuaaaauuauguauggacauggaaacuugaacuuuuuaugauuuucaugaucacaacuuacucugaucucuuucaaccauuuaaaaauaugaaaaccauucuuaguuuacaagcccuacaaacacuggcauuggguuagguuuggaugaugggccauugcacuccagccugggugacagaaugagacucugucucaaaaagaagaaaauaaaacaggcguuccuuaccuacagccugcuaugauuugggguucuuguauuuuuuuuuguuuguuuguuugagacggagucuugcucuguugcccaggcuggaguacaguggcacgaucucagcucacuacaucucugccucccggguucacgccauucuccugccucagccuccugaguaggugggacuacaggcccccgccaccaugcccggcuaauuuuuuuauuuuuaguagaaacgggguuucaccauguuagccaggauggucucgaucuccugaccucaugaucugucagccucagccuccuaaagugcugggauuacaggcgugagccacugcgcccggccggggaucuuguauuaauaguagggagacaguaagcaagcaaggcucaguuaaugauaaauuguuaucaggagacccagcaguuucugcuuuuucuacccuccucuuugagcucuauuuaaacuaauagguuacuggguuugaacaugccaugcagugggaagaggcgggaaccccacugagcuguccucuaagugaaucaugcccacuauuugguugugaggcuguggacuuuacuuuucacgcauggcauugaaagaacagggaaggguggauuccccaucuccucuuccucuuuggaaucaggaaaacauguuucuauucuaaauguucuuugauaaauaagauugcauguuccuggcuccuguaacauauauuuucuuuuuccuuuguccggcauacuugacuaauuguagagcuuuuugagccuaaaacuggauaggaacccagugcaugcacucuuaaggacucagaggccugcucaagguuaagugcaguauggucugaauaauaagcauagaugccccuuuacugagcagcagcugggugcugggcacugugcuaggcauuuuuggaugcauuuuccuccuccaacuucacuuuccccuaugagauuauuuccucuguguuagagacaagaaaaaucaauuuacagguaguuuaagugacuuguucaaggcuacaguaagcuugaaguggcaaggaugggauuugaacgucugucugcuugauuccaagaccguggccuuugucauucaggucaugcugcuuuccucaaggcaaggaacugagguuuucuguuggcagugaggugguggcuucuuguuucccuggucuuagauacugcucaacucacaguugaaauguagaagugaaaagucagacagcagcagguguugcugggaauguggagaaguuggaacccucacacaccauugguggggauguaaaaugguacagcuaacuuggaaaacagucggcgguuccuccaauagucaagaguucccauaugaccuagcaauuccacuccuagguacguaucaaagagaaaugaaaacauggaccaagacuuguacaugaauguuaauagcugcauuguucuuaauagccaauagguggaaaaaacccuaauguccaucaauggacaaauggauaaauauguugugguaaaugcguguaauggaauauuccauuuuauauucauaaaaauggacaaaguccugaggcauucuauaaugugagugaaccugguaaacaugaggcuaagugaaagaaguuaguuacaaaaguccacauauggugagauuccguucugugauauguccagaacagagaaauuuagagauagaaaauagaugagugaugacucagggcugggggaguugggggugggcgggauaggagggguagaggugaaggugaugaaaauguuuugcaauugucuguguugguugcacaacucuaaauguacuaaaaaucauugaauuauacaauuuuaaaugggugaaucguaugguaugucaauuauaucucaauaaagcuguuaaaaaaucugaaagugucaauuaaucuuugcucccagagaaaaccacucagggcccgagcugcucaugggcacaaaaacccauuccucagauuccuuggccaugcuggaagccuggcuugugugagagccucaagucucuguaacagccugggaguguuggucccgucacagggcuguggcagccuuuaaagcuagaaggcacugcucagaggaacugguuccuuugaauccuuuuccgucaccaugcaaauguuuacaagcucuaaucaggagaaaugaaaaaucacaugucuaauuuuaaauauguugccucugaucacagguguuguuaaaacagcucuuuuaugacuuuauaaauacucagauuuauuuugaagcaauguuucauuauuccuauacuaugauuaaauauugagacuauugcuuuuccaauuguucuauugcaguauuuaaugagugcaauuaaauggaaaaauugccuuuuuaacuggugauaguccauuagugucucugucucuucaggaaagaaaagaagugaauuauuagaaugacaaaugaggcaaaguuaccaccgugauggagaggugcgauuucccuccacauaaucuucaguuagugaucucuguaagagaauguuuuucaaaaggcuaauagagaaguaaugagaucagaaggaggucaacccggccuucuccguuuggcagcuugauuaauuuauuucuccuucuuggagauugcugcaaggggcuuuugucacccuguguuuuucaugggacuguaaccugagugacugcugauauauuagccuugcaggcaaggaagcaaguccguugcccuggaauggaaggcauaggaguuaaggguuuguuugcuuuugcaacuugaacacacucauugggagcuuuggauaaugacaacaaugaugaugauuuuaagaguuaaucaaauuaaaggcuaugaaaugaugcccacuguggauccugugccuggugcucagcacauacaacaucauuucauuuucacagcccuugugacaugauagggcucuuuugcagaugaggaaaugcaggcucagaguuaucuagcauuguacccuuaagcagaagggggagguaggagugaaucucugucugccucuaaacucuugagcuccccuccagaaguccagggcucuuagaaacuuuguacucaaccauuaaauuguugccauugugcugaggagcaaggaaacugggaucacacagcuagaucacagugggggaaccugaauuauggggaugcucacaaaagggcaaaacacaacgguugcugucauuugaugcuuuauguuaagugugcauaugcucaguugcagaaaccuaaauugcuaaauugcaaggcuguauaugauaugccaauuuggcauauucugucuuuuuauauucugccaccccuaucauacuuaggaaaaugccagguuguaaucauucacugggagaaacaagggguugaacguuguuaucgcgcaaaggaagcugggccuaguaaaggaauguaaauacuaaaaugccagcaucacuguuacuuacuguguuucucuggauguauuacuuaaccucucuggcuuuauuucugccugcccuccccccgccccccccccccgcaaugccucaaucuguggcagaguuguuacauuauugaaaaagaacauaaagcauauuuucuggcauacagcauauguuuaauuuauaauuuuuguuuuuaucauuaaaagcaacagauugcuguauucuugccugccacugacauggacuuaauuguuucauuuagacauuuaagugggcaauacacuuaaaaugcagauauaacuuuaauugucaaaacaugcuuauuuuaggaaauguguuucuccaguaaagcucaguaucuggggcuuuuucgguuguauucuauaugaaucuugaauacugaaguuucucaccauggagaugacaaacacauaaaauguuuacuuugcaaacugaauuucucuugcugcuuuuucugaaguuccccagaggcucaucaucaucaauaccaucaauuaauagucauccuuggcuuccucgauccucagcacugcgcugggcacugccccccaggagcauccaugcaccucaaauccugaccuugugacuuucaagucccuaagugaccccacacugaagaaucuggugaaggccauccaagcccagaguucauuuaaguggcagcgaugggaccaaauuauaggccaggucugucuuaugaaagaugauaaauggaugugucauaucgggaaagaaaucacucugucaucauaugacaggcuggcuugauuucuuugcaccagugucccuaaaaguugggaugggggugugaagcgugccagcuuucaaagccaguugucacuccauuuugugcuguaccuccccaguuaugaaucuggggcaucuucacuggacucuccaagccccaguacccucaguguggaaggagaaagcaugacccacugggcaggacacagaaggcuucugugagaaugaagcucuaucaugcuuguagaacauggagcgcucagcaaauacaaaucacagcccaucuccuccaaucauuugggguauuaggauucccuucacuccaacucccacuggaaaaccucuuugccaugacacagagauuccacaaucuucuauuuuuauuuaaaaauuuuuuuaaagagugaucuuugguuuucucaguagaugcuuuccucugaauagcaagcauauagauagucuucuccuucagacccccgaccauggcuauauuauuuagucuacagugguucuuuguacaaagugcuucugcaaagcucuuagagcacccagagcuggcuuuggaaagcaagacauuaggaaugagcuagccugaaugaguccugauuuuuuuuuuuuuuuuuuuuuuuuuuugagaugaucuucuucuguugcccaggcuggaguacaguuguacaaucuuggcucauggcaaccucaaacuucugggcucaagccagccgcccaucucagcuacuuaguagcuuggauuauggguuuguaccaccuugccuggcuaauuuguauuuuuaguagagaugacauuuugccauguuggccaggcuggucuugaacuccuggccucaugugauugccccaaccucagccucccaaaguguugggauuauaggugugagccucuguaccugaguucugauuucuuaaauuucacagucccuuaccuguaacucaaauucccgaaccuucaaaaaacaacaaguggcagcaaaacuugauuuggaauugucguggucuuguuuauaaucgucauuuuucuugucaugugauuugauguuuggguauauguuaacaccucacuagggauauuucauagcauaugauugauguaagucguaaaaaauuuagaauccuucaacacauacuuggauuuuagaugaagaaucauagauuuuuauuucuguggcuuuggaugagcuguuuaauuuucauuucaaguugcugguaagaugaugaugauaauagagauaauccuguaagaaugcugcaaaggguuaguacuuuauucuugcaacaaguauuuauuguaggccuguauucaaaggagaauaagauaaauaagaucgaauguggaaauuagaugaauccggaguuagugcaaugaaaguuacuaagagagaacagaaauacucuugauaaugcugaugugacuggacuuuugacaagcagucugggacuucugcugaaaagugcucuugaagccaagcaaaaucauuuccacacccucagcaccuccaguuuuuccuggccuuggucucagggugguugaccuuuugccgauguguuuuucuuuuuucuuuucuuuuguuuucuuuucuuuucucuucucuucuuuucuuuucuaacagucuugcucugucuuccaggcuggagugcaguggugcgaucucagcucacugcagccucugcccccuggguugaagcgauucuccugccucagccucccgaguaccugggacuacaggcucccaucaccaugacaggcugauuuucuuuuuuuucguaggacgagguuucagcauguucgccaggcuggucuuggauuccugaucucacaugauucaccaaccuuggccucccaaagugcugggauuacaggugugagcuaccgcacccagccugcugauauauuuuuaauuaucauaagaaacaguuaaagugaaauugcaaccccaugguaucgguggacugaacguuugguucucauuuccuugagaugguaguuuccuccucuggcuacuuuuguccagccaguucuccucugugggcauuuggggaagggcucucugauagaaauaugaaaugaugagggaugcaaaaaacgugguuuguuucuuagaacaaccuccaccacgaagguuccagacagagugaaauuucuguauuugcugacccugucgccaguagccuggaauaaacagcaaaaauaguucuugaggcuucguggcaaaugugaccuaccuuuguaguucuuggguaggugugugacuguggccuaugaggccaaguugcaaggucuuuggaugaacuuuguggcaucuggcaauguccccagugcaaccuauguaaaauauagcaguuuccugcacacgcuuaagggaagaaaccguuguggggaagcgugcucuguuauucuugccaauguagccaacauauacauggggaggucuguuuuauguuuuauguuugaugguuuuuucuuuuucuuucuuuuuuuuuuuuuugagacagggccuugcuuugucacccuggcucaagugcagugguagaaucauagcucacugcagccucaaacucuuuggcuccagugauucucccaccucaaccucccaaguagcugggacuacaggcguguaccaccaugaccagcuaaucuuuuaguuuuuguagagacaaguucuugcuauguugcccacaguaacauaguaagucucaaauuccuggccucaagcgauccuccagccuuguccucccaaaguacuggauuacaggcaugagucacugccuggugcuuucuuuuugucuuuuucuaauaaccauugcuauagaugguuguccuuaacgcguaaauguuuaaaauaccuaaaugccuaaacguuugaaaacauuccuuaaaaauugaaguuauagcauacuaacaaguguucauuuuuauaauugcugauuuaacuuaauaaaaaccaauaacuauaaauauccuuaaugccacugaauuguucacuuaaagugguuaaaaugauaaauuuuguuacguauauuuuaccacaaauuaaagaaaauuaauauuuccaacaagccaaagcucuauguaaauguccuaaauuaauguguuuaaagagaaaauuucaccagugauaauuuuuuuuuuuuuuccccugagaaagucuugcucuguugccaggcuauagugcacuggcgugaucucagcucacuacaaucucugccuccuggguucaagcaauucuccugccucagccucccgaguaggugagacuacaggcgcaugccaccaccgccagcuaauuuuuguauuuuuaguggagacgagguuucaccguguuggccgggaugcucucgaucuuuugaccucgugauccgcccgccuuggccucccauagugcugggauuauaggcgugaaccaccgugcccggcagggaguaacauuucuaugcaacuauauguggguguauuuuucugaacaugucagugaaguuuaaauauucaucucacuucuuucagucacccucaaaggggaauuuaauuuacgacuucauuuguacuuucaaacuuccuccuggaaacagaagaaaauaaaauuagauuuuuguaagcugagaugauaugcauguucuuauuuucaauacaguuagucucuccacuuuauuuuuaaacacaaccucauaauacaaauaaucuagucuuuucuggagcagucuauuuauucagacagguggaaguugaugcuaaagauuggcguuaaauugaguaaaccauucauguaguaaauaagauaauuuguuucugccccccaaaagauuaaaauauagauuuuuuucaaagucuguuuuuuuaacaccuacggucccugaauauguucgauugagguuugugucuguaauuuggaacggcuuuuuguugcaacuaaaauauucauuugcagaaauuaucacugaggguguuagcuucuucaugcuugcguuucuugcauuuguuacuaaauaaaauauuuagaagucacgucgauuuucaaaaugauaguuaaggaugaagguaauauuggcauauuuauuuuuaucuguguaauuuuugcaacuuauaaccccuucagguccaaaugaaacaggcaaccagguaauaaaccaauuacauucuaauacagauuacuucaugacagugucuuauuuuccaguuuauauguaggugagauucuuuggagaccgucuucguaauauagcuaguuuuuguccauucauuuugcuuugacuuccuuguauagguacaaagguguaaguaggagagucuaccaggcagcacacagacguggcccuguaaccacccuuguguaaaaucagaguaauccucccuauccuugcuuauuucacuggguucaugggugaugacuguaaaugacacaggagacagggaaagaguuuuguuauccugauacacacauucuuaaaugccucuagcuguguagacauugguuuguccauauuaauaguauuuuacgaagugccaguugugugccugcuuuguggcauaugcauuggcauucauugcuuuauuuaauucuuccaacaacgugucagaugucuguucaaauuauuccccccuuuacagacacagaaacuaagauuuagagagguuaugcaaugugccaacagggagaaguuggagcuggaauuugaaccaggcuagcugacuccaaagcuguguccucaagcaguacaucagagccgaggaaggucaaguuuggaacgccauuuagcugcucucagggagucugauuacuguuucucuguugaggcucagcucaagccuucccugggccaugaaagacaacuuagguuuggguguccuguguuuguaccuuguuuugugcccaccuacauccuggguuaugucuuuccccaccccaagccuuuuuugccaucucuuuuucccagaaagacuggaaacuugccuaaagagacagaaucccagaucccagauggaucuacuauuuuagaaucucugcuuccgcauuucuaaaauccuucccagagaauuauuugacuaguuaaagcuuaagaaacaccccaguggauuaugagugccuucuagccaagaauggguauuuccucugugcaaucugagggcacgggacacuccuccagcggaguagccugugauuuguaugggcugcaugaauuccugcacuaacaagguaaaagaaggauguuaaagaaaacccgagaucuuuuggguacaugcuauaaggugaaaggcuuauuccauuugcucaagaacaaacauccauuuguccaccccaaguauuuauauaguucaauuaagcgggcagguaaacugauuuuuugggugguuaaugaucugaugauuuuccucucugucauugugauuggauaugauaaucugagaguugcccaaauuagugccuuuacuguaguuauaauaaugucaugaugacugaggaucacugagugugccuuuugcucuguuaagugugcauucagaacuuuacuaacauggguuccacaggaaauauuagccccauuuugcaaaugaagaggcugaggcucagaaauuuaaaauugcuucaugucgcacaguucaguguaaaguugcaaugcaaacuaagauguuuccguugcuuauaaucuuaacuauaauaaucauaaaccauguucuguugcucagaacccuuguacuuauaauauaaaacaaucuuuuuaaccaagauucuucgcuuggguauucugaguagcauggaagagcauuauacuuuuuuuuuuuuuuuuuuuuuuuugagacagagucuagcucugucacccaggccuggagugcaguggugugaucucggcacacugcaaccuucgccucccagguucaggcgauucuccugccucagccuccuggguagcugggacuacaggagcauacucccacacccagguaauuuuucauuuuugguagagacggcguuucaccguguuggccaggcuugucucaaccccugagcucaggugauccgccugccuuggccugccaaagugcugggauuacagacaugagccaccaaaccuggucaauuuucuaugguguguguuacauuuuuuaaaauuuuauuuuaauguuuauauagaaaaaguugccuuaucaaccauuauaaucaugguauuuagugaguguaaucuguucugauguaauacuuaguuuaacugguaaaaaauauuuugacagaauuuaagauuaguucuuuuugcuuuguccgucaaugugaaauaaucaguauaucauauuuauagaauucugcuaaaacaugcauauauacauaaacagauauucaucuuaauugauguuaauugagauauaggaguacuucauuaagucuccagaauacauacuucauaagcaggaggcauauauguuuguauauauguauguacauagacuugauacacaugaaauaaaauuucaaaugguuccucuguucagcaaacgugacccaaaguuuuggcuuauuuggcguuuuguuuucuugaagacauacuugaauuuuaaauaguuaauccauuuaagaaguuucauuuaagguacuguuaaaaagaaaaaacacagaacaacacagugagagcagaaaagguaucaucuccucccccucuucuucucuuuuagaaaccuugcgugauccacugaugguaaauauuucauguacuuugcauaucagccugaguuccuuuugugaagucagguaaauggaauguaaauccccucguccuccagacaguaaaacggcauuauuugauguuacaucgcauaaagaugcagauuugauucccccuuuacucacacuauaaaaacaaaguuuuuaaagugguuagccauaccuggaaauguaaaugcauucgccuaauguaaugccaaagaaaaauuaagacaaaugauaccacaucgcugccacaaacugcggcucguacaaaauucacuuuaguuauuaugcugugaauacgggcucucacccuccuccgugaaugcacaauuuauguugaaugcaacaugaaucauuuuaauagaccaagcaaaaaguccccaaagucgauuuucaaauuaugaaccuuggaacagaauauaacaacagcgaacaacaaauaguucagacuuuacucugagcuaugagugaaccauuaaagauacagcaagcacuuucggugagguguuacacaauucauagccuaauggcaaaaauaucagaaaugggguauuuuuuaaugcuguuuuuccagccaucauucuguucaauuauuuucacauuuguguaaucaagauauucccaaacagaacauagaguuguguauuguugggaacuaauuauauguauuauaaauccaagaauuaauuuaaaugacccaguuuccacagagaaaaagccacauuguuuuuaaauagcuaacuaaacaaaaugcuaacccauaugggagaaauuuccaaagaauuaaaaccacccaccaggaaaaugggaaagucuccccuccacacacacacacacgcacacacacacacacacacacacauacacacacacacacacacacacaaaaucaccaaaucacaccugaacaagaggaagaaaauuaaacucauugaggagauaccaucuuuuuuuaaaaaaaaaaaaaaggcagcaaaaugugagaugggcguuuauuaugagauacacgaagacagagaccagagguuccccaaguagccccuggaccugcagugucagcaucaccugguagcuuguuagacauagaaauucuugggcuuuauuccacacauaaugaaucagaagcuugugggguggggccugcagucugagguuuauuuuuucuaaaacuuuaaguuccaggguacauguguaagaugugcaaguuuguuacauagguaaucaucugccacggugguuugcugcagagaucaacuuaucaccuggauaugaagcccagcguccauuagcuguuguugcugaugcucuucccaccaccugcaagccccaguguguguuauccgccuccaccguguguccauguguucucaucaugcagcucccacuuauaaacgagagcaugcaguguuugguuuucaguuucugcauaaguuugccuaggauaacggcuuccagcuccauccaugucccugcagaggacaugaucucuuuccuuuuuaugauuauauaauauuccaugguauauauguaccauauuuucuucauccuaucauuuaugagcauuuggagugauuccguguccuugcuauugugaaauaccauuugacccagcaaucccauuacuggguauguaaccaaaggaauagaaaugauuguauuauaaagguacaugcacauguauguugacugcagcaguuuucacaguagaaaagacauggaauucacccaauccgaauuuuaacaagucuuccaugugauucugagacagacucauguucgugugguucuggcucugcagaacugaggugggccccaaaacuugcguuucuaaaagguacuagcugagcaugaugacucacauuuguaaucccaccacuuugugaggccgaggcggguggaucgcuugaggccaggaguuugagaccagccuugccaacauggugaaacuccaucucuacuaaaaauauaaaaauuugccggguguaguggugcacaccuguagucccagcuauuuggaaggcuggggcaggagaaucgcuugaaccugggaggcagauguugcagugagccgagaucaggccacugcacuccaaccugggugacagagccagagucugucucaaaaaacgaaaaacaaaaaaaaccaaaagacuaaauguauaaaagguacccaggugauguugaugcuacuugucuuggccaaugaaaugaaaagccuacaggccaggcaugguggcucaugccugugauccacaacuuugggaggcugaggcaggcagaucaccugaagucaagaauucaaaaccagccugaccaacauggugaaaccccaucccuacuaaaaauacaaaaauaacaccaaaaaaaaaaaaaaaaaccacaacaaauuagccagguguggugauguggccuauagucccagcuauuugggaggcugaggcaggagaaucucuugaauccaggaggugaacguugcagugagccaagaucucaccacugcacucuagccugaacuucagagagagacuaugucucaaaaaaaaaaaaaaaaaaaagccuacaguugacaggcagauaacagagggagcaaaggagucuuguggaagacaauagggaguguugaggaccugucaaacaacacaguccccaucuguacuuugggagguaaggacuucuuaguuccagcugccuguugccaugggggaacauagacccagagcugccaucuuuucuaauuuuuuuaaaaauuagaggcuaaaaguuuuggcuuauaaaaaugguauuuccugaguuuuuacaauuauaguauuaagauauuccuagguuuuuguuuguuuucgagacgaaguuucgcucucauuucccaggauggagugcaguggugcaaucuccuccgccucccaguuuaagccauucuccugccucagccuccugaguagcugggauuacaggcgcccgccaccaugcccggcuaauuuuuuguauuuuuuaguacagacgggguuucagcauguuggccaggcuggucucaaacuccugaccucacgugauccacccgccuuggccuccuaaaggguugggauuacaggugucagcuagugcaccugacccuaggauaaucuuaauuuuaaguagcugguaacucauaaauuuuuaaacacucugcaguucaaagaaaacauguuugugguagguagccaguuuauaaccuguguaagacuguguuauuagcaaaucccucaauguguugaccaagaguggguaggaauccugcagacagaaucuuuugaaggugguuuguuuuuuuauuccuuuauaaguacaguuguagauuuacaaaguaauugaguauauaguacauaaggucuuguguacccaccgaucgcaauugagcauauaguacaugcuguccuguguacccacugaucccugguccugccccugguaugaggguauuaacaucuugcauuaguguggcacauuugcuacaauuaauaaaccaauaucgauacauuauuaacuagucuauaguuuacaugaggggcugcugcuuguguuguacauucuauagguuuguucaaugcauaaugacaggugucugucauuucauuauggagugaaaccauuccaauuucauacagcguaguuucacgccucuaaaaguccccugaaaguguuauuaaaaguacuaucuggccauguccucauuuccccagcaaaguccuucugagaauuuaggcgcuuuaggcuagaggaucucagugcucagaaugaaauaucccuguacuccaagaugccuccagcaauuauaauugaaucuugaagcuagaguuucuuggcuauccuauuucccuuuuguuuccaccaugaagaaguggagagccgugugaccucagugguagagcugauguagaagcgcccucucuguuccuggcagugccuguccugcuaaccucgugucucuugcuggggucuucaucaguaagagaccucacaagaugcuuuaucaggucacuuggcaaccaagcugaugaggauagcaguuucuuuuguucuuuuaaaacauauauaaaauuauuuuuaucaaacaugacagaucaaaagccuucuggaaaggagagaugguaacuaauuuaggcagugucuuuugcuuucacaugguguacccaguacuauuaauaugaauuuaucacauggaaacaaacuuuuaaaaaaauuaauuuugugaauuaaauaaagcagcaugcaaauuuacuaucguauucagcaaccaaaauuuuaucacuugccugauacugccuagugagcagguggaaauguagacaccaacacccucauggauucccagcugcugagaguuugaauaguaugugaagucuguagagacaaaauuguuguuuuccccaguuguaaagugugcaauauuauccuugcaaaauugucuguuuauuuuuuuugcccuuuugggggacaaaaugucuuuauguuaaauuguuuuauuauuguuaucuuuauggaguuaagggcacauaaaauauucuuacagagagaaauucuguaguuuccacaaguaaccagagaauuguucaaggcagagaauuauuuuuucaaugccuauuuucuccugaauuuucugacggaguuagagauaggaaaauaccauaaucugcuauaaauucaguugaaaaauagaaauagugagaaauccagguugugcucugucguaauuuaagccuaauaugugauugucuacauguuuacaaguuaccgccuuuuuauuucuucucuuuuucuguuuucuucuuccauuuuuauguuuugcuaugccauucauucauucuauucuuuucauuucuuuuucuuuuuguaaaaauuguacagaguuuaaaguuagucagguaugucuauuaaauuuuuacguaaaaaguuaaagcagcccucagcaucaacuucuucuucauuucuaacucauuuagugaauucaguuggucuuuauauauguagcuuuaaguaauugcauguaaacuguuacuucuucauuuucuagucuuagauauuaucuguagguuuuucaauaagaaggaaauuuagcuuccuucuacuuuggugccccaugaugaugugcaucuuuuuuauuucugcaucauauccauauagugauaucauguauaaugauguuuaagaagacaguuuuuuuuguuuaaauuguuauaaauaaguaaguguaugcaccacuaugccauguagcauaucaagauuauuuuucuuuccugcaccuuauuuuuucccuggaguuaauacucaucuuuuuuuagaaauuugcugaguuugugauguaccuaucauucaaccucaaacuuucaugugauugucuaaaucucaguuccuuuuauuagaaaaaaaaaaaaaaacaacuccccuggagccuuuguaccuucugcaguuugggguuguuguccuuuuugcuuggugcacaggaauacuuggugauguucuuuuuaaaacugcccucacauuguauccuggaaaguucauuuaccuguacccggaguuggaacuucucuuccacaucuuuuccuguauugguuugguuauuguuuugugggagcaugucuuguaguagcuuucugaaaaaggaugauagaauaugugugugugucuguguguguguauuucagguuucaaaauguuucuguuccauccucauuuuauucauuguuagggauagaauuacagauuuaaaaucaauuuugcuucagaguuuuaaauucuauuuuguggcuuucuguguuguucucgggaaguacaaacccuugugaccgcuguucucuuucauuucuaucugcuucucucuugggaguacaaugggaggcauaucaucaaccccuugcugcuauccaaauaggagacuguucccuuucaagagaauuuuagguauucagauccuagaccucccagauggccucauaaguauuuuuauccucuauuuaucuuugucuuuguguuacuuucagggauaguucuucuagucuuuccauggauuuggugggggggggggggacguuucuauuuccuuuauguuugauaacauucuauucuuguuucauggaugauguuacucuuuuaacucucugauguuaaugauaauuguuuuaauuuuucuuuucuguuuaguuucuaucuucucaaaauuguuuucauuucuuuugguaauuguguuugaugauagucuuuuuuuuuuuuugagauggagucuuacugugucaccuaggcuggagugcaguggugugauccugccuaacugcaaccuccaccucccagguucaagugacuguccugccuuagccucccaagucgcugggacuacaugugcgugucaccaagccgaacuaauuuauuuuuauuuuuuguauuuuuaguagagaugaaguguuuacccuguuggccaggcuggucaugaacuccugaccucaggugaucugcccaucucagccucccaaugugcuaggauuacaggcaugaaccaccacaccuagccucuugauaaagucuuuccccaaauguucugaucuguggaugucuguuucuaucuaaguagaauucaaaguuacugcugccaacucuuagcacauggccacggccaguuaacuguggacuccucugaaggaugaucuggcuggacuauuuuuugggaaaaccacuguguuugaauguuugcauguguccuguuggcagaacaaauaucccacagaaggaucuucuuaucuucugcuuggggaagguguagcucugacugcuagaguucuagagccaagugagggggagaguucugagucucugcauucaguagguaaacauuuacaaagucuguguuuucaguaucaugccacuguucucaccuguuuauguucucuucugauaauaaacuucugucauuuuucuggaguuaugaaaugaugguauccugcugggcugaguggggagggauucucaagcuguacauagcugacacacagguuucuaaaagguugucuuucaaccccauuuucagaaguaccagguuccacauuuucugagccuuugcuggcucucugauaggaauuguguuacuucucagcuguccccauggcuagcuuaagacucagcucucuuaagucacuuccuaguuguccaucugcuuuccagcauccaacuguaauuuuuuuuuuuuuaagagaaaugaagucucauuuuguuucccaggcuggucucacuguaauuccugggcucaaguuaccucucaccuuggccucccaaacugcugggauuauaggcaugaaucgcugugccuggccucaacuuuaaauuuuuauauugaauaaucuuugauuuguauugucauguuguuuuauagcaguuacugcuguuuuagugugauuugggaugaaaauuuuaaaaaaucaauauguauaauccaccaucuuuguuccuuuuauuuuuauguuacucauucuuuuaagcuugucuuagacgugaguauuauguuuuauuuugcugggagaacaauuugggaaaauuugagcagcaaaccauaaguuucuuggugucuguguacuuggagcucugaaucacuauugucacugagggaguggacaggaagugaugcugagauaagucuagaugggauaggugggcaacaugcaggagaaaccuccugggaaaggugagcaagagcacacaggugagacauagcaucgaguguggaaaccuccauggguggcaggucaguguugcugagggauguggacaugucugaggccaaauagaugagucccuauuggguuuugccucuccacaaucuagaggaauauuuauggaagguuaacagggcaugguggugcacaccuguaauucuagcacauugggaggcugaggugagaggauugcuugucuuacaggaguugaagacuagccuuggcaacauagcaagaccucaucucuacuuggaaaaaaaaaauuagcugggcaugguggugcucaccuauaguaccagguacuucggaggcugaggcagcagaauggcuugagccugggagaucaaggcuacagugagcugcaauugugccacugcacucuaauuuaggcagcagaaugagacuaugucucaagaaaauguucaagaagaaauacaaacuauugaaaaaggaaggcugaaugcuuuaucagaaaacuguauuuggaggggaccuuucuggggucuuuuagucaggguacauaagugucagcugcuacgacaaacaacuugcaacgucucauuaucuucauacaacaaacgcugauuuguuccuuucauuacauauccagugugaguuggcuggaagguccacccuacacaaccacucgugaaggcagacuugaaggggacuccacugucuuggagcuacacucuaaaacaaauagccuccaaagucaaggacucuguaacaggaugaagcagcauuuuuuaugggcagguuugcacguggcauuuguugcuuccaucaacauuccacuggcgagagugagucccuggccccuauguaauuaugagggaggcugagaugugagaagcacauggguguugggagagcacuaaaggucucuagcccagaagcaugacuuccagccaagugagacagggaagcccagaaaaaugugucacagaacuuauggcaucagaaucugauucccaggcaugcuuuccaccauaugcauagacauuugcaccccagggauagcaccauuacucccaaaaauugcagguuugaaaggguaccuaaaaacaagccaccagauugucccauuccacuaucauucugccaucaacaccgaggugucggaguagcaggagagccacauauuucuuagugaggggacccagaaugaucccuuuugugcuagaggaucugaguucauuucaugaaacugaagcaucuucuuggagauauaagcucaccuugggauaggcccuugcagaugacaauaaagguauuuuggcacauaaaaaaacugcucagcacaccuuguauuuguauuuccuuugacgugaaccauggccauccaguaggccacgcaacauucccacugccauguuggcuuguuuuucuuuuguuuucuugucaacauaagccucaugagacaacagcaggaugcaagauuguacaaugacaccaugacucugcuuucuggguguccucugugggcucucagcaguguccccgauguggagggucuucuuauucugugugugugcccucugcuguugaaaguugccugucacccaugaugcugugcugauugagcaaacuaauccauaacccaccgccacguuccucgccuacuugcuucuaggcacauuaaacggucagugcacagguccucauuuuucucaugcuuccauuuccauauucucaaucaaucacugauggccagcugucaacaggcaccauuuuuggugggaccugaagauguauaucccuuguuuucagauuccucgccucucaucauguaaggugaugcucugagcugggucuuaaagcuucugggcacagccccccuugagucuucauuauggcaaaucuagugcaggugcugagaggcgguaacucuuuaaagggacaggauauggaaacguggcuucauggacaguauuuuaguauauuucuguaaauagcacaugugcuagauagcagauuuguguauggauaugcacccggcuagggaccucuuuaauggucauucauuugggagaugaccuuugguuccuaaacugguggacauaccaaggacuaaaggagugacuugcucucaguucuuugucauucagcugcuuuaauauuaauaugacacccguuuugggcuugaaaaguuuuccuucugcugagaaaugaugauggugacaaugaugacaaugacgaugacccuugguuggagcaauguagucuaaaugugguugcaucaucuucuuucuuccuuugccuuccucccuugcucuuuuucugccccucaugccggcuccuuccucccacaucaccccacauuuuuuuuucuuucuccucaccaucaagaaauguuccagaaugccauuauucuucgucaccacggucagguauaucauccuaagggcagagggugaaggugcguaauuaguguuucaccagacugagcaucauccucgggcaggugcaggggagaauggcugguauuuaugagugaauggcagcguuuugacaggaugaugaauaaauaugcugggcccagaggacuccaggugauaagcauuucuuuguggucugguaagugauagcacccauugcuuaauuucucuaaaaucugcauuugucaauuuuguauuuuuuuauuugaaagguauuugcuuaaauaaauaggccauauaaaucuagcucccaauguccauuuucaaaugauuuccagcaaggaagauggaauuaccacgaggaaccuguucucuuauguuucugcuuagauggcugggucuauaccaggguuuauuuaaaugaacacaggaaaugccauucaccuuuaccaugaaugggaaucuuugccugugacucuaucgugugaauuagcagagcuuggcuauuauuccccuacuucgguagauacuggcuguacagaagggaaccccaguuucaaugaguaccuaugugcugggcacuuagcugguuuuuacacacauacuucauuugaagggaaggaauugacugaaaagaauucuccauuccaacuucccaagucaguugccauuuggcccugauaaagcuguacuuucucacuuguuccuuauuuaaaauagagaaaagugcaucaagcucuuguuaaucugucaggccuuccuaagaugucugaagaaguuaguuuggugaacaugggcuucagggucagacugcuuguguuccauucuugauccuaucacuuccuugcugcgggaacucuggaaagucacuuaaccucucugagcaagcuuccauuuuuccaggugaaaacgggaguuuagccuaguccccacuugauaagaugguuguggaaaguauugugcgucauggaccuaaaguaccuaggagauuguccuggaugucguuuucucauaaaguugacuauggcuauuggugguacuaguaugacugucaagucgaucagguggcugaggagcaguacauggggguauacagagugcaggccucagaacugcagaacaucugcacaaucuccagcaagcuaaccucucuggacaucguauuccucaucuauaaaagggagacuucaaucuuauuuaauggcaaaagucacaauuacuuuuguaccaacguaauagaauuaaguaaaauaaggcuagacaugcuggcucauaccuuuaaucccagcacuuugcgaggccaaggugggcagauuacuugagcccagguguuggagaccagccugagcaccauggcaaaaccccaucgcuaccaaaaaaaaaaaaaaaaaaaaaaaaaaaaaaaaaaaauuuuagucggguguaauggcacaccuguagucccaucuacucgggaggcugaggugggaaguuugaaccugggaagucaaggcuacagugagcugugauccugucucuacaccucagucuggguggcagagcaagacccugucucaaaaaaaaaaaaaaaaaaaaaaaaguaaaauaaagcaugggaagucccuuauacaguuugugauauggguacacacucagugaaauggccauuaauacugcuguucuuaacucugaaagcagagugggccauuugaaugcucacuuugauauuuuuuaaaggaaaaauuugaggcauugacacaugccuuuugcuuacuugcuuggauugguuugaucaacuuuguugcggucuaauuuauguaaaauaaauugcauccauuuaaauauacaauucaaugaguuuugacagaugcacaugcccaugaaaccaacacgaaaauaaaaaaaauagaacauuuacaucaccucaaaaagauuucaaaugccacuucugugguguaugacucugaguccagacagccucagcuccaggaaaacccuggucuguuuucugucacuauugaugaauuugcauuuucuagaauuuuagauaagugaaguuuucuaguacuuguucugcaucugguuucuuucauuccacauaauuaccuugggauguacccauacugcugccuguaucaguggcuuacucauugucauuggugaguaguacuccauuguguggagaaaucacauuguuuuaaaaauaccuaauuaccugcugauagacauuuggguucuucccaguuuuuagcuguuguaaauggauacuaaugugaacgaagccaccgugaauauugaugcacuagucuuuguguggacauauaucuguuuuaucuugggggauaauacucuggaguggaaugggcagggugguccguauagggcuauguauaacuuuuuaagagguuggcaaauacuucccuaaaguggucaucccauuuuacauucuugccaacaguguuuaaggauccacuuccucuacauccuuaauaauacuugauauuauuggucuucuaaauuuucuguuuggguacauagugguauuuuguuguauauuuuuuuuuaauugugaaauaugugaguaugaugaguaaugauuuugaacaugaaaacuaugcuuauugcucauaucuauguuauuuuauuauuuacuuuuuuugagauggagucucgcucuguugcccagucuggagagcaguggugugaucuugguuuacugcaaccucugccuacuggguucaagcgauuuuccugccucagucucuugaguagcugguguuacagaagccugcuaccaugccuggcuaauuuuuguguuguuuuauuuuuauuuuauuuuuuuagcagagacaggguuucaccauguugaccaggcugguuucaacuccugaccucaggugaucugccugccucggccucccaaagugcugggauuacaggugugagccacagcgcccgguggucauaucucuuucuugcguuuuuguggggguugggguaauagguuuauugagauauaauucauauaccacacaguuucauuuuuaguguauugacaggugugcagucaucgucacaaucaagccauagcuucuuuuaaacuuugucuuccuucucuuucuaauuaucuccuucccccgcccccuccauucucuuuccauccuuuaaaugucagugucccccacaauucuguuguugacccuuucucccucuggccaaugcuccuuccccuguagaucauacccauucccaagauuucagucaucaaauccauuccaauaugacuccuguauccauaugucuaguuccaaguaucuguccaugguguuggucccagguuauucgcaccucauaugucuuuggcacagcacucuugacagcucauaaagucacgcuguuacccccacaauguccccccacauaucauugcuaucccuccucgacacccacaccucuugcauguuccugagcuucuuaggcguguugcaucuuccugaccuucccaguccgaagcccaaggagauacuugauaaauauucgucuaauaaauaaaugaacuuguguucuccauauuccuugaaaauaugcuucacuuuuaucuuuuuaagaaauuaauugcauuacuaucuuauuaaaggucaagaaaaauaauucauaucacucacuauucaugagacugcuaaauaguugcccuggcaauuucugauuauaauuuuagaaauauuucuaaccucuggccuuuuuucuuaucucuacuuaaagcuuuucuggaaggaauucauuuuccacuuuccuuaauguuccuuaaauguuguacauaucuuaaaaguggauuccucauaaaacaauauggacuauggucuuauucuguuuaacgguaugaaggcucgccugaaaggccaagaguaagauucuuuuaaaaucaugcccaaguuuuaaaggaauauaaaacuuucucuuuaaaaauauaccuuucugcuuccauccccuaacccacaaagcucaagucuaguuuaauucaaacuuggaaauaguucuuuuauuauugcucccugcaaugggaacagagcugaggcuccuaaggucuagagucaacaugaaaauaccuuugcuucugggccauagcuguguuucuucuuaacaaggcagaagcccagaagagacuucauguacugugacuguaauaaagaggguuguaaguagagaagcuggaauuugaaagguuacguacaagucaagcugccucuguaaugucacuuauauccaggaaagaguggcaaagaaccaucccagcagauagcuugagggugggaagggggauagguuguugauaauauggaauaggagaaaaaagaucauagagccaaagagcucgauacauauacugaugcgguguuuauuuuauuuuaguuuuuugagacagggucucugucgcucaggcuggauugagugcagugaaucuuggcucacuguagcuuuugccucuugagcucaggcaauccuccugccucagccccaccaguagcugggacuagaggcacaugccacuacacccaguuaauuacuacauuuucuguagagacgggcuuuccccauguugcccaggcuggucucuaacuccugagcucaagagauccacccgccucugccucccaaagugcuaggauuacaggugucagccacagugccaugcccugaugugaugcuuaaauucagaaauugggaaggagggucagguagcuauaagcaaaauacaagagaaauauaagagaaagaaagacuuguaucuguuguuagugaguuuuugugguggugauacauuaauggaggcaacagagggucagaaaucaggguggaaaauagcccagcagaggggaaaagaggaagucugaacgagggccacauugcagauagaggccgguguacuggucugcucaggcugccauaacaaaauaccacaggcuggauaacuugaacaacaaaaauacauuuucucauaguuguggagccuagaauuccaaggucaagguuccggcacaguugaugucuucugaggucuaccucgucugcuugcagacagccgccuucccaccguguucucacgugaccuagccgcugugugcacgcaucccugguuucuuuuccuguguucagauguccucuucuuugaaggacaccacucagauugcaauaggaccugcccugauagccucauuuuuuacauaaucaccucuuuauaggccguaccuccaaauacagucacauucugagguaguacggguuaggucuucagcauaugaauuuuggggaaacagaauccagcuaacaacaguuggggaugaggcuauaacgaauaccacugccuaauguuugcacggggauaucaugcuuuucagagaccaucugcauccuuaucucacuuaauccuugccccacccuuuagaagaagccaggaggagguccuagucagcugaugugagauuacauggcccugacugucuugccuggugcugcaggccaccuucacagccuugccauaccuuuucccguuuauccauggauugguaugagcccuaauggugcacccuuccgacaauccuucauccuucccagacguuucaucagccaggugaaauuugcaauuguuucagugauugaaauuaugcuuggagugcaggugucaccgaugaaacagcaaugccuugcggugacaaauucaguguagaaauaauuuuagcaagcccagugauuggaaaacaaugacucaacuuugagcuauauugauuuuguauuucugggcucagcuuuugacucagucucauuccccagaaauaaucccuguuaacauuucgguuuguguuauggaaguguucucucuucuaugaauuaccuaaugcccauaccauacauaugccugcauuuguacacucuuaagccaaauaacaucguacuguguauuauucucuaguagccugcuuuuuauugaacuuaaugauaaauggcaaacauuugaccaugucacuuaaguuucuuaccgugaucuccaacagcuaggcaauauucugucauauggguuuaccauacuuuucucaauccacaaucucaucagagucccaauaguugccugauaugucuccaucaguugugagguauguuucaagugauuuauuacuagaaauucuuagcgagcugaaguuuguaaauuuucucaagcuacuuuauugauauauaacacagauacauaaacuuugcccauucaaaauguacaauucagugcuuucaguauauucagagaguuuugcagcugucaccacagucaaguuuagaauauuuucauuuucccaaaaagaaacccuugacuggcauccuuuuccccacuuccuuuucucuccacucccaaccucucucccagcuccagguaaccacucaucuacuuucugucucuauauagauuugccuauucuagacuuuucauauaaauaaaucagauacuguguggcccuuugugucucgauccuuacacuuagcaucauguuuucaagggucauucauguuguagcauguaucaguacuucuuuuuuuagggcugaguaauauuccauuuacggauaugccacauuucaucuaugcauucaguucacggacauguagguuguuuccacauuuuggcuauugugcauaaugcuuccagguacacuugucuacacauuuuuguguggauauagguuuaccuuuuuugggguaugcuccuaagagugcaauuucuggaucacguggaacuccuuguuuaaccuuuugaggagccaccagauuguucuccacagcagccacacccaucuacauucuaaccagcaguguaggaagguuccgauuucuccauaucuucaccagcacucgcugucauuuuucuuuuuagucuugucauuuuauuggguaugaagcgguauugcauugugauuuugauuuggauuuucuugauggcuuaggauauugaacaucucuucauaugauuauuggauggaugauuuuuuucagcgguuaucaggucacaccuguaaucaugcccaccucauuuucuuacagugcagugugugcuuuuaggcacauaccaagagcuuacagagauccuucugguucagaggaaagauucacauccccaacaaacacugcuccccgauuacaauauagagaggcuaaauuauaguccauaucacuuuuccuuuaaaucccuuuacuuuuuugugcuacaagaguuucagaauaauaauuccgcagaaaaaaguacugauuguccagcaguugugucagguagaaaacugggaugcccgacugcauugguuuagccagaacuauggccaugaaaccuugccuggcccccagggauggggugaggggggauaucauauacgcuuuagguggggcagagggguggucugccccugugcaggcaggaauguucaggaagcaggcugccucuguuucuacucuaaauauuuaacauucacggauggcauggauccugacuaagcggagcagaugcuggcucuauauugcacauagcuccugaauaucagcccugcguggcuaugcauguguuuuuuguuaguuuuugagacagagucucggucucuugcccaggcuggaaugcaguggcacgauguuggcucacugcaaacccugccucccagguucaagcgauucuccucucccagccucccgagucucugggauuacagacguguaucaccaggcccagcuaauuuuuauauuuuuacucgagacguaguuucaccauguuggccaggcuggucucaaacucgugaccuuaggugauaugcgccccucagccucccaaagugcugggauuauaggcaugagccaccacgcccagcaguauguuuguuuuucuucaaaccuagaucaagagucaaacacucaaauguuuggugggagcaguugaugauccagagcuuuggagucagcgagacaguagagagugguggagaugguggcgcacaagagggucagugccccaucucaaggaacagcugcaccucggccuaugcgauugugaaaaugugagcauaugcaggccagaccuuggcuucucugucuucauuuuucacaggagccagaaguuuggaugugcaaugugaaaucucacaaauuaaacauguuacauaacuguauuuuguuuccuaucucugcuguaauaaauuuucucaauguuagugacuuagaaccacacaaaaguuacacuuuacaguuuuggaggucagugguccaaaauaggucucagugggcuaaaaucgaugugucagcaggacaccauuucuuucuguagguucuagaagagaacccacuuccuugcuguuuccagcuuccagggacugcccaaauccuuuggcucauggccccuuccucuaucuucaaagccagggauggcugcucaaguccuucucaaacugcccuguuccugguucucucucuucugcuucugcuuuuaaggaaccuuguaacuucagggagucuacccugauaaucugggauaaucugccuguuugaaggucagccaauuagcaaucuuaaugccaucuacaaccuuaauuaccauuugcuauguaacauauuuauagauaucagggauuaguucaugaacauauugggguagagggcauuccacauacagcaguaccuauaauguauaugcuucuuaaagaaugcaugagucuuaaauuuauuuuauguccuuggaguguauagcagaguuagauagauccuucuggauuggcgguugauugaauauuggcuguacaaagaaacuggauaggaguauagagaaaagaucaaucauagcacuagcuuauaguuuauuuuauucuuuaaugauuuuuuaaaaauauuucucucacuuacuugaaaagcagucuuagaaauuaacuggaauggguaauuuauucgucuuucuucuuuuguaaaauaauggcaguuuguaacucagauuuuuguaugaggaauaaauaaaauacugucuguuuuccuuugaucuuucuauuugugguccagccagccagcuaacuaugcauuccuuuuucugccuuuucaucauaacaccuaucuuagcaacucuucauugcugcuuugcaaagaggauuugagauuguuuauguaggggcccguguauaauaccucaagagaaaaagacacagaugaggcuauuaggauuaagggaaaaucaaguaaaucgagagguaaagcacugugcagaaauauuggccagaagcuaugaacagaugccacagcugggcugaagaguuaccugugagccuuccagggguguaagccaagagaaagacaguucaccaaaucuaucgauuaauagaaaucauccagcagcagugccacuguaagauguucaauacguagcaccuuucugucccuucuccucuagccaguugggacaggauuagcaagccaaagacuuucugaaauaauccuuagcuauauucuugguauucaccaaggaauuuaccaauaugcaaagacuuggggauaauuaguauuaucuuugccauuaccugcaguaauauuaugaagauuagagauguaacucuguccugaagaacugcagucuguggcucaccuuggagaagaacuuaagaacuuauugaagugagcaggcucaccugccuuugcucagagccacaucaccugcaggcaggaucugcaaggucagcaguuagcgucaaguugcacagccugggcuuggguggcguucgcuuuacccuugcccuugauguggugccgaguugucaggauucucguaaaauuccugggugauggcuucuucuguucucuuuauuuccuuaagugaacaucugucuaauuguucaccuccaucgcuuucgugcuuuccucaugcuuucucucuuuccagacaauaaacuuuauuuucuucauaagaauucagucuacgcaaggguauuaggcagcuuguuugcaccuuuuaauuccuggauguuuuccagaaaggcuguuugcaguaguuccaguggguucaucugugaaucaggaaagacaaugcagcuuuguguuuugguuuuuaucaguuaccuucuguuuguaaacaucuguuuggaaacguuugcuggugcccaccccagcacccccccaccccugccagaaauaaagggauuaaucucuuuuugcuuggcauagggagaagacagugucugcugaugugcuuaacuuuuuuuuuuuuuuggucagguguguagguaugugacugaaacccauagacuuugcacauauugucaaaugacuuuccagagggacucaggcacuuuauuuaauuaaugccaaugaagcccguuaauccgcucauuacugcaguuuaauuuugaugcugguuuuugaugauguauugaaaacuuguauaaacuggcaauuacaacuggaaaacauuucuaguuuagaagagacccuuauuuuucauaugcuuagaaauauccagcaagccacuuuuaaaggcuuuuuaucacauuuuauucuuaagcuuucugaauuccuuauuauauuuugccugauaaauaguuggauuuuguuuuuugguucaauguaagaauauucuuaaacuagguaaacuguuuuguuugucauuauguucucucauucuguuaaauuuuguuuucuauuuuucauguuuuuggguuuuucuagauggccugucuuuaacacuucuugauauuuuugauuaaauuuucauauaucaucaaaaacagagaugacagccaggggugguggugcaugccuauaaucccaacacuuuuggaggccaaggugaggagaccaccugaggucaggaauucaagacuacugggcaacauggugaagcucugucuauccuaaaaaugcaaaaauuagccgggagugguggugcaugucuguagucacagcuacuugggaggcugaggcaggcgaacugcuugaaccugggagguggagguugcagugagcugagauggagccacugcacuccagccugggucacagagggagacucugucucaaaagaaaagaaaaguagagaggauaguauaaugagguuccugucugccagucacucuauaguaacuauuaggaaaccccuuuuuuucucugaagucauugcuccugugugugugugugucuguauauaaaaaaaaaguauguauacauauacguauauguauguguauagauaaaaaugcguguauggugcugggcgcaguggcucacgccuguaaucccagcacuuugggaggcugaggcgggcgaaucacgaggucaggagaucgagaccauccuggcuaacacggugaaaccgugucucuacuaaaaguacaaaaaauuagccuggcgugguggcgggcaccuguagucccagcuacucgggaggcugagaccgaagaauuacuugaugaaacauggcagacaacguagaccagcagcaaacuaccaacacuguggaggauccccuggaucuuaggcucagcccagaggagcgaauuugugugaaaaugagaaacgaccgagagcuucgaggcagauuacauacuuaugaucaacauuuaaauaugaucuugggagacguggaagaaacugugacuacuauagaaauugaugaggaaacauaugaagagacauaugaaucaacaaaacagaauauuccaguguucuuucuccggggagauggcauuuuccugguugccccuccacugagaguuggcugaaacaaagaauuuguccuguacggaaaacaggagacuuuguacaguggccucucuaaaugugcaagauauucaaaagagaaacccgcauacauuuggauauuaagaaauaauucuggggauucuuccacuccugaaaugaguugauuugcagauaauucacaacuucuuaagcuaaaugguauuuucguuuuucucaagcucuuccaauaaauaugaccaccaagauuuuuuuuuccuaaaaaaaaaaaaaaaaaaaaaagaagaaucgauugaacccgggagguggagguugcagugagccaaggucaugccacugcacuccagcuugggcgacagagcgagacucugucucaaaauaaauaaauaaaaaugcauauauguauauuugugugaaucauauacacauauauaaaauauauguaucauauacauauauaucacauuucuuuuucuaguguguguguaccuugauuuaugucucacauauucaaaauacucaacuuguuuaaaauaagagcacaaccuauuuaaguaguaaagauucaaagccuucuucuaaaaugcuuaacuuuccuguggauuuguggacccgugggaaaaucucaguccccaggcaggaaggaaggagauaugacacaucucuaguuuguuguaagucgccuacccuagaccucaucuccagugcucugaauguggagagguaggugcagggcagugggacagagaggugcacuuugaaagacuaucacauggaaacaaaaguuccggcugggcacgguggcucacgccuguaauccaagcacuuugggaggccaaggcgaguggaucacgaggucagcaguugaagaccagccuggccagcauggugaaaccccgucucuacuaaaaauagaaaaaauuagccgggcauaguggcaugagccuguaaucccagcgacucgggaggcugaggcaggagaauuucuugaaccugggagguggagguugaagugagcugagauggcaccauugcacuccagccuggcagacagagugagacuccaucucaaaaaacaaacaaaaaaaaguuccaauacacaauauguuauaugagaucuucacccaaucaaggauuaaauggccaauuccuaaaugaugccuaccuuuuuauggccauguauaccuuugccucaguacuacuggcauuugcugacauccauuuaucaagauacagggauggauuucuagaaggcccaggcaggggugcuggccaggagacaccaggcauagaccuuccuuucucagagccuucguggccccuaguuugaaucuuugagucacugcaguaaaguuccugauguuugagaguacuccuuaugaagggagucauaugaguugcuagcuggguucucuggaugguggugucaugccaacaugggagccacuagcacaaagaacaugcuagguucuguugagaccugacuuugggaauagcauagguacuuaccuuucucagcaccacacaaacacacuccagaaugcaaaggaaccugcacugugccaucuugcuucucccugcauagccacuucucuuuccagugguguuuguauuuugguucauucaaucaaugaaugauugauugaaucaaccacuuggucccuucaaucuguaaccuuccugcaacacugucuuugugauguuaucauaaccuugauuuuugagggauagaauugggcauaaucagagaaaacguggucugggacacauuugugggcuauucuaugcuaaacauuuccauaucauuaauguucaacacagcuuugugguguuggagauaggauuaucauuguuaggaugguuauuaucaauacuagcugugauuauugaucacuuccacaugccaggcacagugcugggugcuacauauuuauuaccuaauuuauagcuugcugcacucuugcuggguauguguaauuauucccauuucacccgaucccugggaguuuggugaauuaaucacccagcauccaaauagcuaaccaguagcagagcugggauucaaacucaguuaggcugacuucugugccuguuuucuugccuaagcgguggacgcauugaguaggagaaggccaguuauuccucuuugucacugauacaacuggggaccuguugccggagauguggagcugugcauuagggcuggguagaacacacauaaugaaccauaugcacgagaacuuuuucaucuuucugcauacacuuggaacuaguucuuuguuuuuguaaaagcaucaugcacuagguaaaauguuuaauaacacagagaaaucuaauugucaaguaucuucucaacacacauuaaucaacaauucuccuaucgaaagauaaccucuuguauuuacaaaaaaaagaagaaaaagugcugucaucaguaaauucauucauguauguuauacacucacauacaaaacguaucuauuugauuaaauuagaacucugcuaaugaauuacuuuccuugauugcacaguaauaaagucaauguuguaaauauaauaauuauagccaagugcaguggcuuacaccuguaaucccggcacuuugggaggcugaggugggcagaucacuugaggucaggaguuugagaccagccuggccaacauggugaaacccugucucuacuaaaaauacaaaaauuagcugggugugguggcacaugccuguaaucccagcuacucaggaagcugaggacugagaaucgcuugaaccugggaaguggaguuugcagugagccgagauaguucuacugcacuccagccugagcaacagagcaagacuccgugucaaaaaauaaauaauauguguguguguguguguguguguauguacaugaauuauauacaaaugagggaaaauauacaaaugaguugaauauauacaaaugagggaaaaauuguuccuugugucaggaacaauuacugugaauuuuguguagcucuuucugacuuuuuaaaauucaaauauauuucauaaaguugaaaucacacuguggucuuuuuuuuuuuuuuuuuuaaccagacauauaguggccauguuucuaugucaauacauacuguuuggcaguacaguuguacugacuugacauuauagcuucauaacuuaguaaauuaaucccuuauugcugggcacagauucuguuuuccauuuuuucagucaugagcaacguugcugguuuaccugggcuaaauaagaaguuuaaaugcaaauagauaaugcuugagaaagcuucuucccauauauacucuuucuguagcagugucugagugucuguaccuuccuauaccuucaccauaucauguauuugucauuuuauagugaguuguauuacuugcuaggugagcugguaucuccucugauaacacaaagaaggccuggguuugcuuggcaauuuguuccaauauucuuuucaguuuuaaauaaguuuugaacaaaaaguuuuagcauuuuacauaaaaaccucuaaagcucucaggcuaauuaguaauguagcauauacaaauuaaguuuuuuucugcugugcuuaauucuuauuaacacacuaaucaugagagcccccaaauugcuguaaggagcacauuuagaaaacauauaaaggaucgauaguugguacuuaagaaaucguugaaacaccuuuucuuuuuuaaucuaucuuagagcugaaagauaaaaagacuuaaaaugaguuagaauaugaguuuuucagcaucuuauagcuuaugaguuaaagcaagauuuaaaaaauacauuuaacauacuaaauauuucaaaagcuacagagauaccguaacauuuaaaaaaauaaauuuucauuguggaaaucaacugccacaaaaacacaaccuuuuacgagacaacgugaugugcaugagaagcccugauguugagaagcucauaauucggugugagaaacacacaaggcaugaugccauucccaucugggaugaacagggaagacuuccugggagaggugacuauggacuuaauuuuguuuugacacagcaaaaacaugaggaaugaauuuugugacuuggaagauuguuaguuuucuguggagggaacaacacucaucuugcaaauuugccuucacuauucaaucauuagaaaauaauuuuaaaugagcuuagcaguucucagaauuuuggauuucaggaaacaaacuuuuuaaaaacaaaacaaaaaggaggauaccaauuuaagcuugucaaaaagauuuucccccaaaagaaaaacacauuaaaaacaacgacaaaaaucaacaaaaacuaacacuauucccccaucaacaaucaauauuacuuucuaaaagcaagggcguuuugacaccagauauugugaggacauccaccugcucuaagggacagccauuucacugguguucugucaauuuuuauuuugaacuaauuuuagacucacauagaaguuggagaaguaggcugggcacaguggcucaugccuguaaucccagcacuuugggaggccgaagcgggcugaucccuugaggccaggaguucaagaccagccuggucaaauagugaaauccugucucuacuaaaaauacaaaaauuagccuggcauggcagcgcacaccuguaaucccagauacuugggaggcugagacaugagaaucacuugaagcugggagcuggaggcugcagugagccaagcggagugccacugcacuccagucugggcgacagagugagacucugucucaaaaaaaaaaaaaaguugcagaaauagcaauauuucacaguaccucuacuuucuuguaauuuuagcaguuuaccuaaucaugguauaauaaucaaaacuagaaaauagacaauggugcuaaauauuaacuauacuuguuacucaaauuucaccacuaaagcagugucaucuuuuuauuccaggaucuaguccaggaugccacauuauauuuaauuguuguaucuccuuggugccuuuagugcuuuuuuuuuuugagacacggucucacucugucacccaggcuggagcacagugguacgaucauggguuacugcagccuccaccuccuaggcucaagcgauccucccaccucagucuccugaguaucugggacuauacgcaugcaccaccaugccuggcuaauuuuugcauuuguuuuaucaaggcaggguuucaucauguugcacaggcugguuuugagcuccugggcucaagaaaucugcuuaccucggcuucccaaagugcugggauuacaggcaugagccacugcaccuggcuuggagcauucagucuuugauaguugcuuacuuauuuccuucuuucugaucuugagaccuugauuuguccaguauuuucucaucauuagcugaguguaagcauuuuuuggcaagaacauuauaaaaaugauguggugucuuucuuaguauauuaucucagguagaacauaauguugaucugucucaucccugguaauguuaaccuugaucacuugguuaaggugaugucugcugaguuuuuccaauguaauguuauuaauuuuuccuuugaaauucauaauuauuugaagggagauguuuugagaugaugcuggcagccccguuuuccuuaaacuuucacaugcugacuuucuauuguuggaucuugccugcagcaguguuuaccaugaugcuuggcuaguggugacuauguauuucccuuacucuuuuuauagucaguaauuggaauucuucugaagaaagagcuaucccuucucccccauuucuuucuuuucuuuucuuuuuguugagacaaaguuucacuccugucgcccaggcuggaguguaauggugcgauaucggcucccugcaaccucugccuccuguguucaggcgauucucccgucucagccucccaaggagcugggauuacagguccaugccaccaugcccagcuaauuuuuauauuuuuaguagagaugggguuucaccacuuugaccaggcuggucucaaacuccucuucucuggugauccucccaccucggacucccaaagugcugggauuacaggugugagcuacagcgccuggccccucccccguuuauuucugauucaauuacuuuauauuagcguagauucacagguauuuccuuuuuuuuuuuuugauuuauuaauaccuccauuuauucuguugcugaaaccauuccagcuuuuucugguuggcuucuaugaaggacgcuauuuuaauggggugauuuuuuucuucucacuacauucuuccucacuccccacuuuuuauguccgguggccauaggcuggugagaacuugauuuugaacaguugaaggucugcuguuagggacgugcuaaucuagggaauuguacugaacucgugggagcauguuaguaucagaugugugccuuguccgucuugcuuguaggaagaacaagagacgagacacagcaaggugaugauggguaugugaagcaggauaaagaaaaaaacaggacaggcauuacaggcuuaagccuguaaucccagcacuuuggaaggccaaugcggguggaucaccugaugauaggaguucaagaccagccucaccaacauggugaaacccuaucccuauuaaaaauacaaaaauuaacaggcgugguggcaggcaucuguuguuccagguacucgggaggcugaggcagcagaauugccugaacucgggagguggagguagcagugagcugagauggcaccacugcacuccagccugggcaauggagcaagacucuaucuaccccccacccugcaaaaaaagaaaagaaaggaaaaaaaauccuggugcuuguaggagaggcauuuauuucuuuuaggacuggacggggcuuggaggguuuccaggaaacagccucaaccuaaaaauaguagacacaguucaugaagaacuuacuauguguccaguagauaaauauaccacaagcauuaucuucuuuaaucaucucacaaucuuaugaaggagauacuaguauuuugcuugcaaagaugagggaagugaguuuccgaaguugcuaaaugcguaaaggaggugguggugucagaauguuauccugcucagaugguugcaugggacaguguccagaggaaggccucugauuccuuccccagcauuaggcaauauucaagucuucaguuccauguguaggggagaagacuuuccuucugcucccuaaugacagugguacccacacccguauuccaccauaaaaucuuuuuuauucaguauuaggaaaaaagaaacaucuuuccguccaguggucacuguguguguauguguuuguguguguguguguguaugugucuguguguucaccgugcugugugaauuguggcuuuaaauguauuccugucaauuccauauauuuuuaaaauguugcuuuuagaguaugugcaaguuuggggcauuuuugagggcuuuuuuuuuugacggggucuuaauaugucacccaggcugcagugcaguggcgcgaugacagcccacuccagccccaaacucccaagcuccagugauuuuccuuucucagaccccaaaguagcugggaccacaggugcacaccaccacuuccagcugauuauuuaaaaaaaaauuuuguagugacagugucuugcuguguuucccaggcuguccuugaacuccugggcucaacugaucuucccagcuuggccucccaaagugcugggaauacaggugugagccacugucccaggccaguuuuaacucagaaugauuucauaagaaauccacaucugagagucccagaagguaagauauuccccuuucuucuaaauauacuugaccaccaccauucagguucuucuauuaaccuuccuauauuugccaacccucaaccuguuagaaacaagaaaugggacucuggaguagauguuagcaacaucaugagcucaaaccccuccagcuuacagcggagacagugagguccuguaggaugagguuggagagcaggaacuugcccgaggucaugugcagaguucgaggcagggccuggaugggaagcccagcauggagaccccaggccgucucuccgccaucuuguugugaugcuuccggaagaaugccugucacucuugcugacauccgacugaccaagugggcaagaggaauucuucaaaacaauuuaauaaaugcuuacauuuucucuuggccccgugccacauccccccacucagucuuguuuucaagguugaagguuccuucagagcuagugaccuugcccuuccuggccuguggaugucgcucucuauccguaacccuccuuuccagcgacccuguuugcagcaaagacuauaauuuuauuuuggguuuggauauacugauuacauuuuagcuucugguauauuuucuuaccugucacagccauuaaauuuauuuuaauaguuacucuacucuccugauagccacuaaagggggaauuggauauugucuaucaauugguuggucucugaacuaaggcuguaucuaauuacaaggcauuguaucgguucugauuuauuaaccauuuacuuggcuuuggagaaggcagcauuuuuaguaguacuguugagccugcauguagcuuuuccaggagggcagggugcccggaauaucugaucuuacaguuauuacuuugugucauauauaauuuuguuuucucccugcaacaaauaaaucuuugggacuccggaagaaaaaaaaaugggaaagaaaaaaaaaauuugugguuacaguauaauaaaaauaaacuguuugucgugacugcagcugacauuuaucagccuguuugugggugcucuuucucuauaauacagaacauaauuugucacuuuguaaauacauuccagucuaaaucccugccagcaucuguuaguguuugaaggauuaaugugcuacccuguguaugucugcacuuccagggaacaguguagcaucugauuacagaucgugggagagcaggagggaacaagguguuuucugugcuuuuuccuacaugcagucguuuuggccuuuuucugauuuuucuugucuuuaucccauucugucuagguaccuggaauuucauucuuuacaaagauguuccugguccccaaccuuucuucugucugugauagucacagcugaagucauaguauuuucuguguacuauggguugagcuguggguaauucuuuggggccgguuagacuuggguucaaauucuuucuccaacuaguuuaugagcuuaaguuaugugauuuccauuucuucacuugcaaaaugaagaugcuaauaccuacuucuugaagaugcugagguugagggaagaaauaaauguuaaugcaaagugcccaguuuagugccugccaagaguaacuggugggucugugucaccuucugacauuaucagugugauugucuccaacgcauccauggaagugaaaccgcuggaggaagcuaaugccgugagccagcuguugguuauguuuuuguuuuguuuuucuuuuuuacuugcuggauaguggguucuguuuauugagaaauauuuacauccgucuaaaucaggugcuugcuaggguucuuggcacacagagcaucccaccaauaaacugugguucccaacaaggcuugcaacugaaucugggcaacaaugaacaugacuucaauaaugacaaaaagauucagauuccugcuggaagguccauaugugcuguccccaguaggauucuggaauucccugaaucauaguguugcuuguaauucuuuccacauuaugaaguggcucuauagacugccuaccaccuuguaucuacugcugucguuuagauuaggaacagauugccagauguggaagaaauagccucauuaguaacuuuucuguaagcaaucuccuuauuucuuguuuuuuguucuuuuguuuuuugugugugcuucugcgugccccuccucuauggcuccccccaccaaauuucugugucuucauuugcaacucucuuuucuccaguaaagaggaaaguguauaguucuccuuuccuuacagaaacauuauuuuguuauuguuguuuugguuuggguuucugaaguauaaaugcauaugaacuggacagaaguauuaugcccaugugccagguggccaagauggggcuugugauuugaagcuucuuuuccuagauucaggaaaguaucacugguuaaucagggaauacaucuuucggcccauuggaaaaugucuguucuuagcacccuaaaugcccagguauuagcauacuugggaaaugucuagaaaccccuauuucaauuuacugaccauuuuugguaaauuccuagagaugccaaaaugcauuucaaaaagcuuucauguucaagaagacuuguggaaugauagaaaacauuuaacgcuguuauguacgaagugaaauacuguuaaacuuuuagauuauuuaauagaagacacauuuuacaaggcaaaguguuuagauaugcucccuccuaugccuauccacacauccuuaacucuucacguuguuugagacuguuaggcuguuuuuuuauuguauauuucaucaaauagugggugauaaaacaacagacacucuaaggaauggcaugacauucuccuuucuucuccugcauucauuggaaccugaauguaguauuaauuauaagacuguuagacuucaggggacuacacucuuauucuaaaauaguggucaacuaacugugcccuucagacagaauuccugcccagcaccuggcuuuguaauuaaaguuuuacuggaacagaggaauaccaguuaauuuauaucucgucuguugccacuuuugcuuucaugcuauuaaagcugaguauuugggagauacuugaaaaaucuaaaaugcuuacuaucuggcccuuuagagaaaagguuuuccaaucucuguucuagaggauucguggucauuuggaaagaaaaguauguuaagacaaaaugagcaggugguuggauuaguauuuucuuucuacacauauagaaacuguuccuaucauacgugacucaguuuucaaacuugcuuaauccaaagccugggggguggauguaggagagaaguugaaauuagcugggguuuuuuuuuuguaucacaaaaguuacauuuuuuuuuuuuuuuuuuuuuuuuuuuuaagacguagucuugcucuguugcccaggcuggagugcaguggugugauuucagcucacagcaagcucugccucccagguuuacgccauucuccugccucagccuccuaaguagcugguacuacaggugccugccaccacgcccggcuaauuuuuuauauuuuuaguagagacaggguuucaccauguuagccacuuuggucucaaucuccugaccucgugauucaacugccucgcccucccaaagugcugggauuacaggcgugagccaccgcacccagccgaaaaguuauaauuuuaauggucuaaaucaaauuuguucaaccugcagccugugggcacauguggcccaggacagcuuugcagcccaacacaaauguauaaacuugcuuaaaacaugaugagauauuuuuugccauuuuuuuuucaacucaucagcuaucauuaggguuaguguauuaauauuuuaugcacagcccaagauaauucuuuguccagugucacccagggaagccaaaagauuggacacccugggaauaaaacagaaaaaagguguaaaaggcuucgaguucauggacagaacaacauuuuuguaaguaaaguauuuacggauguggccccuuuguaaucuccugggcucagggauaauuuccaggcuggggagaagguugugucauggagacagcaguacuguuuuggaaggagaauugacuugucacaauggacggagaacuaccaucccauuugggccaaccucuuuuuuuuuuuucuuuuuguuucgagauggagucucgcucugucaccaggcuggagugcaguggugcaaucucagcucacugcaaccucugccucccgaguucaagcuauucuucugucucagccuccugaguagcugugauuacaggugcgugacaccacaccccgcuaauuuuuguauuuuuaguggagacgggauuucaccauguuggucaggcuggugucaaacuccugaucuuaggugaucugccugccucagccucccaaagugcugggauuacaggugugagccucugugcccggcuucugccagcuucucauuaugauuuuugagcagauuucgcugcuuuuucugccuuuguuguguuuauaaacuagaaguaauuaugucaacuuuguaagggcucaguagcguagaauaaggccaugucuguaaucuccccuucugugaacagagguuauguucucaaaagccuucaauuaacaugaguggaauggauuuucuaaauuuauauggaggagaaaguuguagguccuauaugagugaugacaggugauacuuaaguuaacuggaacauauggcccuuagccacaauuuccccacaugcccuucugggggaugcuuuguagaccugauaucccagaaaggaguguggacucauaaagucacugcuguccuuugguuuuccugauguaccaaauguaguaaggccucuuuucaaugugguaaaagcucugggccaccccauaaggcugcaagcgcuagaagcucuucccauagagaacaucuauauccucaaaccaaggagaaaaaggaagcugcuguucauaaauauugaagaggcagggagagcuugcacugaggccaggguguauuaacaugcaugccaucgugaaguggcuucuaauggacauuuguaaggugguguccccucccuuccccuccccccucuaaugcugccuggguugcucuuugcaacacgugcagucugcaacuuagcuggcuuuuagcaaaauuacccaucgcgauucauuugucccauugggccaugggauaggugacuacagagccagauucgaauguggcccugugccggugcccaaaccagcaggcugcacgugugcacugacagaaugguacaucccaccacugcucugugucugugugcgacugucaguugcucucuacugcuccucauagacuuccugucugccuuucucugcauuucucagucuccccaucuccccuucuuaucuaauccccuuccuuccucucucaacucuuccuuccucuauccuuuuucuuucccuuuuuuuuuuaacuauucuucuuuagaguuuguuuucucauugaacuugugauguacacauuaaaggaaaacucauuaauguggaaaauuaggagcaucauagcuaauguaugcucagggcuuacugugugcuagacauuauucugaguuuacacagugaugucagauuucuccucugucacaguaaguuccaaaagauagugaagaauauugcagugaaaacacugaaacucacauauuucauacucagggguaucuuuuaagugugaagcaagagaaaaaaacguggaaaaaaaaagacucaggaaaugcuuuccauuuagcuuucuugacuaaguuaguggaagacuuauuccagauuauaaagagaagaaccaaaauaaagaguuuaagaaugaagggguaugcagcaacugguagggucgagucuccucaggcacaacaugcaaccaaggaggggcagcucacucggccugcgcuggccacacaagugcaccugccacaguauugaggggcuggacugauuucucauuaaugucugggcaaaacucaaagaggcaaacauuuucauuacauacuguuauccauccuauugugggaccaauuucuccagaaaggucucucucggugggaggauuaauaaacaccaucagaaauccaauuaaacccaauuguuaaaauccaacaaauacguugcuuguggauacaguuguguauaguaauguguauggugauggccuaucauauaggaaugauagaggcagcacagugcuguaauggaaaccauaagggcacgcacaauggcucaugccuguaaucccagcacuuugggaggccgaggcgggaggaucacauaaggccaggaguuugagaccagccuggccaacauggugaaaccccaucucuacuaaaacuacaaaaauagccagguguccuggugcaugucuguaaucccagcuaccugggaggcugaagcaucagaaucgcuucagcuugggagcuggagcuugcagccagccaagaucacaccacugcucucuauccugggagacagagcaagacugucuccaaaaaaaaaaaaaaaaaaaagggcauggaucuagaugccagacaaucugggugcauaucuuugcuccaaaagcaaagauuguaaacucucuuuacaaucuggggcaaguuagcuaaucucugcuucaguuugcuccuuagcaagaugggaugauauuaccacuuaccucagagaguuguuaaauggguaaauucauauguaaguguucuuagagcagaguucaguacauaguaaguacuguguaagaauuggccaucauuaauauuauucauuggauaaauaucaaauucaaaauaccguuuacauugggaaagggaaaaaggagagaaauauaugagagacguaugcuggggguaucuacgauguuuuuuuuuuugauuuuuuuaugucauuuuaaauguuucuauucuucuguucuguucuuaaaguaugccuguaauuauuaggauauaauuauggauucugucuuauuuauuuuuuaaucuucuuauugugucuaucuuuugucuuucuccauauucugggagaaacaucuaaguuuccauuccuuauaacugauuauuuuucuugggaucaauucuggucuucaccaucugccaaugugaguuuuaguuucucuauaaacuuuuaaacuuuaaacuuuuuuucuuuuuuuuuugggggggggggggcaaugcauucuuaacccccuuccaguuuuucucagccuauucuuguuuguuuuuguuuucuauuucuguuucauugagaugcauacaaaauggaagauggccaacauuucuaaaaauuuuguuuccugacauagagaacguuuagaggucagguugcucugagacuguguugugauuucuuuuuuuuuuuuuuuuacuuguuuguccuuucuuuuauuaucucuugcuguuauccucacuuuuuucuuugcuguucuucauccuuuaauuagcauucaaacuaaucguuauuagaguguguaacaugaucuuugacauaccuagguaauuuuacuuaaguauaugaguuaaguugauacgcacaguuccucagcaugaaugucauuguuuugcaaauuuuagcugaaggugacaucacuguacuaaaauuuucuugugcauccacuuccuagcuaugacucucuacagauggauauaacuuuuuuaagaugaaaaccauuuauuuucaauuucuaguuuaacugccucacaguaaaaaaguguacuuuuugugauggcaggaauuugaaguauguugaaacugccuuugugaucuggcucaugguuaacuucaauaacguaugaaaagaauccauauuuuuauguguaguguucuguagcucuuuuaguugguuuauacucuuuuaauggucuguugaccauuuuaucuaaauauuccauuuugucuuuuacuuauuucuauuauaaaugguuaaucucuucuacuaagauuguuaaauccaucuuuuuguuuauggcuguguuauuuggcacaugcaaguucaugauuguuauauauucuugcuuaauuauuuuucccuuuaugcaucauccauuuuuaucuuuaguguuuaguguuuuuuauuuuuauuuugccuaaaauuuuauuuuuauguuaauauuugcuauacuagcuauucugcuuucaaaauguuccugauguuuuucuuuaucuuuaucauuuaucuuuuaucuuuaacauuuuuauauuucucucuuuuaaucauguguguuagguaggcaaggauagcugcuaggacaaaauauuuucugauguuuuaauagcuuaacacaaugguaauuuauuuccagcuuauguaacagugcuuauugggcgcucaguugaggcuggaaauagacaugugaguguuuuauggacuaggccuugaagaaguguaccucccuuagauuuauauuccacuggccaacucuaagucucacggcuaugccuaauugugaaggagacugggcaaugaaucuaguugagugcccugcaaacuaaggcacagggauuuuugugaacagcugguagucuccauuacaguucucacaucuggacaacaaguaccuuuugcucccuuauucucacacagagaacauauucacuuuucuuccaaaggcagagucucaaaaucccauuuaauucuuugauucugugcaaauucuaggguguccuucaugcuuagauaugguuccuuaugguccuguggguuucagaaaggcagcccauucaugccgucuaccccccugcugcucuauauaauagaagguggaguagagacagaauaucaguagcaaaaucuccauuuucaaaagaaaagaaugagaaacauguugcuccaugacagucaaugauagaaucacgcuggggagguaaagaaccuuguaguaagagagcauucuuuauccaggucugaaaucugcucucuggagggaagugcccuguccauuauccuccauggucccaucugaacuggaucuagagaaggguuacucuccuuaggggaauuagcagcugucagcccacuuccugcuggugcaugguugaggcuccguuuuuuuguuuuuagcaguuauaggcuuuuaaggucagauuaaucuuuauuuaauuucuuaauaaucuuauaggauucagauguauuuguuucccauuaauucaugaguaguggccacaccagucuuuccuagacuugaaucucaaguugcuuuauuuuucuaauuuguuaucaucaugccucucuuucagcacaguagcagcuacuaugaggcuauuuggaauaaugagcuugguuugaaaaguagcaucauuaaucugauauaugcuacugggcugaauuauuugaauucauaaugggcuauugucucucaaagacuuuugcaggcuuauuuuaugcuuuuuggacuccagaaucaauugacuuuuucaacucuguaauguccuaacuuucauuucugcuugcacacuggacaaugcuuuuuuucaggaacacaucucuuucuuguaauaucuuuguaaaagcagcguggagcagccagcacacaaugacauuuuagcucuucccuagagcuucagacucaauagguacuagaucuaccuuaugaguuauggcagagcacaauuuuaccaaaagucuuucaguguaaagacacagauccacaugggugucucugauugacaguuggcuuugucuauuuggugaguaggauauccaagcucauuucauuuaguggcuguauuguccccuaggaacuuauuauaacuuaacguuuaucucauggaagguugaaguauggggaacccaauucauaugagaaauagcccaggaguuacauucucuucugcucagugaccauuaguggaaauguaaauaucucaccucaaugcaguguggguuaggaaauguggcuuucugucuagucaaccucuuuuuccuaugcuguggaaagaggagaaguauucugagggacagcuaguucuaucugcaguguaucuuuuuuaaacagcauagaacuauuuuuuuuuuuuaauucuagucuugguuucugccuuucaaugugugaauuuaaguucauguuucuuuugaugacugauaaauuugaaauaauuucuguauuucauuguguuuucuucacuaccaaguuuuucuuauuuuuaaacuuuucugagcauauauauguauauuuuuugagacagagucucagugucacccaggcuggaaugcaguggcuugaucucggcucacugcaaacucugccuccugaguucaagcaauccucccaccucagccucccaaguagcugcauuaaauacgugugccaccaggcccggccaauuuuuguauuuuuaguagagauggaauuucaccauguuggccaggcuggucuugaacuccugaccucaaguggucugcccgccuuggccucccacaguguggggauuauaggcgugagccauuaugccuggccaccaggcauauuuuggaauugauagaauuucuuuuuaucugaguuacuccauacaucauuuuuucucccuguugcucauuuggaagcuaaugauucuuuccucccuuucuuccuuucugucuuucucuguuuuccucucucccuguuagucuugaaagucuuacguacauguuuaaauuuuuucuuagaguaucaaguuauuuaaugucuaucauucuaaucaacaaagccagaccaugcaugauuuaauggaucagugaaauccuuccccccauaaaacaaacuucacuuguuaguguuguuuuaguugcuucuuaaauucauuuucaguauaauuuauuugguccuguagcuacuccaaaugacgcacaaaauuuggcuaaacugaugacucuuuuuguguuuaugguguuuugaguccucaacuuuuucugucuugaauuuuuuuuuuuuuuuuuuuuuuuuuuuuuuuuuuuuuuuaaggcagaguuucugucugucgcccaggcuggagugcaguggcgcgaucuuggcucacugcaagcuccgccuccucgguucaugccauucuccugccucagccucccgaguagcuggaacuacaggugcccgccaccaggccuggcuaauuuuuuuuguauuauuaguagagaugggguuucaccguguuagccaggauggucuugaucuccugaccuugugguccgucugccucggccucccaaagugcuaagauuacaggcacgagucuccgcacccggcccuguuuuugcauuuuuaguagagacggguuuucaccagguuggccagccuggucucaaacuguugaccuuaggugaucugccuaccucggccucccaaagugcugggauaacaggcgugagccacugcgccugucuacauuuucugucuuuacugguauuauggugggaacccauaaaccacugcgaggcagauaccauuuuaagcaggaaaccuuauuuuuuuccgaagcacauuuaaaaauauuuuccaguuuaucuauuaaacauccuccuuugcuucuggagauccucugaaagauuuaucucuuucgauucaucuguaaaguaaaaauaaccgucgucgucauuucucaagcgugacgauacuguuacacguuuacugcauauucugcauaccaagcacauauccgucacacgcaguguggccaacuuccgagaggccggcauucagccaaacagccugaagaaccaggagaaaugccugaguuuccaaauggcuuaugguaaguuguugcugccacuaugaguagccuacuugcauuucuauuuaauggcuuuuccccauauuugaugguauguuaaacagucaaucauucauuuucuaaauuaaagccuguccugaaaacgugcucagugcuauugacugugcaucagguauuagagacacagauaugaaacuguacuuuuuaauuuacgauaaaugucagugugaauuauugguuguuuugcuuuucuuucauagucuccguaggcuucuugggaauggaaauugguauaaccuuuuuggaggacccucaguaaaaagcuaucaaaauuuaaaauguggguaucucuugaccuagugagucuacuuccaggaauucaucuuaaagaaaaaaauuauaguuuccuaaguauuuguauugcagcauugcuuucaguggccaacaaaacaaaacaaaacaaaauuggaaacaacauaaaauaauauuaccggagaaacaaugaguaacauguauaggauuuuuuuuuuuuuuuuuuugacggagucuugcucuguugcccaggcucgagugcaguggcaugauguuggcucacugcaacuccgcauccugguuucaagugguucuucugccucagccuuccaauuagcggggacuaccagcgcaugucaccaugccuggcuaauuuuuguauuuuuguagagaugggguuucaccaucauggccaggcuguucucgaacuccugaccucaagugauccacccgcuucagccucccaaagugcugggauuacaggcaugagccaccacgcccagccgcuucucguagauacuacccaggaauuuucacaguaacuucaaggaagagauuguucuguaauuucuguuuuuacugauaaggaagcucacgcuuagagaauguaaguaaaaaguucacaaagcuagugaaguaugugggggcgguuuuuaaugaaugauugaacauucuuuaguggaacuacaauacuauguuuuuaggaaaaguugcacgauguuuuuacauggguagaaaauauacucuggaaggauuugaaccaggcugucccuguucuuaucuuggggcaguaggacuuuggggcacguuuucacuuuauauguuaucaacuucuguauuauuuguaauacaaugaaccaguuuuauuuuugcaacuaacaguaaguauaaauagcugaugaccacuuggggugaaccgaagugccuaugacaaaccacacgcaggcauccucgggacuauugaggccagauaauccuuuguuaugggggcuguucuguucguuguaagauauugaguagcaucccugaccucugcccccuggaugccaguucacuuuccaacaaguugcaacaagcagaaaugucuguagacauuagcagaugucugcuagcaguuagaauggccucugguugagaaucagagcagacucugcucacacugggcuaucaggguauaguucucucccucccaacagcuggaacugagaccaucucccuccauuugaggaucauuccgauuucccaaguccaccguguggaauguaaaauccuuugaaccagaacagacaaaucuuguuuuugucuuuuuauugaauuuaaccacuauugacuugcgacuugcggcaaucaccagaucccagaucucuguguuuggagcuacacgucuuucugaaucgaggagguggggcacugauuuuucuuuuaucacugacuuccccgaagugggaaguuccagugcuuaacaaguuucauuaagaacacagcuauuaaauauucagaauauacagacuguugcuguugagaauguaauuaugcaguaaauuagcugauguccaguacguugccuuuuaagcagaucuuugauguaugcaguacuugcauaagauauagggcauguuuauuaagagucuucaacuguguauaaaacuagagcagucaaaaguaauggugucugcugaaggauucuuuaucauaugaauuuaccuuuagucaucuauuauuuauuucagcuauuuuauaugccauuauaauaaauauuaugacagagaaagcuuuuacgcuucaacuuauuguacuccucuuuacuugccugcaauccuucaggaaaauguaaccacgcuuuaccuauaguuaacguaaaucaucacuuacauuagaaugaaaaauucacuaugaaaaaaagcucuuacuucaauagcaaggcauaaaugcacaaucauguugacugccaaccuccugugucauucacuguccuuccuuaaacuguuuuuaagcugcaaagugaauauauugcauagagggaaauaggaagguuuuggauuauuuucgcucucuuauuaguuucuggcaggauaagcauuuuuuauccggauugcaaaauauugccaauuacugucuaagcauuuuuaauaguuuugcuuuccauggcacgcaacucauauacuaaauuaaauaagcuguuaucuggugcaauuucuccuugaauagacuuagaauuaccuauagauauugacacgguuauuuuauaaauugaguuccagcaacacaaggcaaaaauuuuggccuguauguaaugaaggaagaguugucaucauuuucuuauuagggauguuuguguauuuuggcagggggagguaggaaggggaccugauggagggcccuggagugaagguugaugcuggaugguugauuugaagguuaggaauggcaaacucagccucuguucuucaagaaucccccugcguccccccgcccugcccccugccuaaaaaaaaggaaauccagggcuuugcuagggaucauuuuuggugugguucuguguuuuaaaauguggaaucaucuccaaaaguguuuguuuauuaaaagcaaagugauaaaaugugucaagucagugaagagacucucaaacuccccuuuccugcgaauccuaucagaaagaacauuuaugagggcauacuuuucaucuuuaggcuuggcaaagaugggucaaacuccccaucagacuggcacauggugcuguuucagguuugacuaagagagaaaagaaucacuagucaaugaaagcaacuguguccccaugcauuuuccagugaagaugcgaucacccauugccaccguuaccauuacuuaaauaauauuagaggaauuaguguuaugaagucccacauaugauauugaugaauuauuaaaccaguugaguuagauuucuauuguaguucagugaauaaugucaugucaauacugugcucaacgccagugucucuugcuguuguaaaugugacagcuccuauuuaagguuuuagaacauaaaaucaggacugagaguauguaaagcggaagggugagagacaucagcauaaugcaauuaaggcccauuggauuagaauuugcaggaugccauuagcaauaagcucugaguguagauuauugccgugcuuacauuuucuccuucagcgguaacacuucucuuguaaauucuaacuggguaaaauaaauaugauauaaaacagacacaaauaagaauauauagaugauguuaauuucuucagagcuucccgguguuacgucuucaagaauaugacgacaggggaacagcccaguguggcagucaugugacgacaugagcauuggaaccagccacaucucaguuggcaacacguaucugugucuuacuagcuuggccacugucacgucacucagccucuguuuucucaucuguaaaauggggaaaauuauagaugcuucagaagauauuugcuaucacuauuaaaugaaaacaagcaugucaucagugcuuauuauuuuuguugcuuuuaugaucaauaaauacaugcaaauuagagcuuuuuaaaugagauucuggaaauaaguuuuuccguauguguaagggagggguagauacacugccauccaaucagcaucaauggguaccuugaagugagaucacaaaauagcuaauucccuguaaacagcaacccuucucucugcaguugcacaugaguagucccccaguuaaaagagaauuuccuccagauacaauggaggccacguucaacacagccaucuaguguaccugggcuucuuccaccuccagccacuguaccgacguguuccuuuauuucacccacauagugaugaugcuuccaacacagcauaacaaagagcugcugcuuugugcugcuagauuugccaaaagucugugccagggauucuuuuguuggagguaaguggagaacgcaaggcccacaugcacaagaugggaguauuuugaagcaugcuccguaagacccaacaugugggcagcagaccaacuacuuggguucacuauggcgagaaaugggauaggagagcgaacucacugauacccucccagcuaauuccuaggcaaucugcaauuaacaaugauuguaaaguaauaauuugugguuuugaaaacuagguuugaucacuggaauuauuccuguccuauguucuaaaggccuguugccuugagauguuuuuucuccucccauuauugguaagcauaauguaggcaugagacguugccuuugaagugucggaaggauggagaggagaaaagaaaacggagauugaaucuggaaaacgcauucaucuuuagaggcaguguuaaugaguacaugaauuuaguccuguaaauguuuucucccuuauuugggacaugguguauugaaggugucuguuaacugugcuaccaaugagugccccuguauccgagggaaacuggagaaguguacuugggcuaccggguuaccaagagcaggacagcaugaggcaguuacagaucugaugguuuuucuuggucuuugucucagcugccaugagggcuucuaaggggcaaggaggguugggggaugagaggacagguacauaguguggacauaauggaauauggaauagcaauugaaaucuugcguugggcugaaucauggcuuugcaguuauuaucuugaugcggcugugcaugagccuuuugaaccucagcuucuccaucugugaaauagguggauaaugacugcacccugcgaagaugcuauagggauaaauaacugcuguggggcaaggacugaaaugguuguuguuuugagauggcuuuuaucauugggccagugacgacccauucagccguaucagugaagagugaagcacugcacucuuuaaggauagggcugaaugguuuaucacccauucagcggugaccaccacaucuuaugcauugugaugaucacgaugauaaaacaauacauaaucacaauauaaggaucuagaguuaugaacuacugaucagguaucauguucugcuccaacugcuuuagauacauugccugacuucccgauagggcaggugcuguuauuacucccacuucacagaggagcaaacuaaauauacaagaagcaguaacuugcccagccccaaaccacccccugaaaaaagaaaacaagggagacccacaguuauuaauaugcauuauuauuggaaaacaauggucaucacauuuuagcaguggccuucaaaauaaugauaauagcauauauugagagcccauuguguggcuuguaccuuauauucacucuaucuaaucuucacucuaaccauagaaggcaauacuauuaugcucauucauaauuaaggcaauugaagcccagauccuuccaguagcuuuccugaagucaaguugccagugcauuggacauacugggcuguaguuccagggcagccuggcucuggugucuuugcugcaaugacaauaucuccccauuucucuguuuaaauaccacacacuccccauaugguuucuuugguuucaggcaguaucgcaucagagucacauauggcuaauuuauagucauaaaaugauacuagagaucacuguugcauaacaacaagaaaccccuuugauuccacacuuacagacucuugagucacuaacacagguuucaguauauauaaagaauagaugaagaagacuuaguguauuaagguggcagugaacugugcuacugaugagugccacuauauucaagggaaaugggagacaugcaccuggguuguuugauuaugaccuucuggcugagcccuggauguugggagcaagugggcuucugagcuacauagaaguugccugaugcuucacaugugggaugccaccuguguggcucuguuuuaaaaugauggguagguagagucuguauacauaauuuaaaauacauuaacauuucuguuuugccugagauaagcuuguacuggugugaucagaaggaagaaugaagauuuggggaaggaaaauuuugagagccauuuuacagcauuucaagauucagugaucucagaaccucuuuugguuaaacaagcaugggaggauggaugauuggauggauggaugaauggauagguaggugggaagauaaauggauagacauauagguaggaaggaaugagggauauauggaaggcuagcaguuuauuuuacgguggugggauuuuuuucuuuuccuuuuuuacucagacagucuuguucuguugcccaggcuggagugcaguggcacgaucaugucucacggcagccucgacuuuccagguucaagugaucuuccugccgcagccuccuguguagcaggugcaugcugcuaugcccagccaguuauauuuuagaugcuuuuuuauauggcccauauucauaugucuuugugacuuuuuuuuauaauggaugugagugugaaguaggaguuggccugaaacaagcccagagagguagacagggaccaagucauggacugaguuaguuguuguuguuccucacuuucuguuuuuauuucuccucuuucuggacacauagcacguugcaccuucuagaagcuaggcacagccacaugacuuugucaaggaaaugugagcagaagcaacaccagucacuauuaaguggaagucuuugagaugccacguguaacucaccacauugccuuccacaugccguagaggcuggcaguguuacagacaacagaggcuccauccaccuggucccugaguggccacggugagcugggcccacugaccuacaaugagugugaagugugagcaagucauaauucuggguuauucuaauuaauggagauuuggggguuguuccuuacugaagcacauccugauugaugcagaggaucuugugagccaugcuaaggaauucagcccacgucuuacugaccacucugacguacuaaaggguugguuuugccaaugaagagagcaggcucugacugaacgaggccugaacuuuucauguucuagauggcaugugcuaauucuaacacuucuuaaugaaagucaugguuugcuugguggugauggaacaguucuaugucuugaauguggugaugguuauaugaauacauacacaugauaaaaugucuuagaauuaugcacaaagguacagcaaagaaaauaaacgcaucucaaguuguguuaguuccuucucacacugcuauauaaacauaccugagacuguguaauuuauaaagaaagcagguuuaauuggcucauuguucuguguucauguucugcuucuggauaggccuuaggaaacuuccaaucauggcgaagaggaagcaggcaaaucuuagcaggagcaggaggacgaauagggggaggugauaugcucuuguaaacaagcagaucuuaggcauacuggaucacgagacagcacuagggggauggcacuaagcuguuuuuaaccagccccaugauccaaucaccucccaccaggccccaccuccaguauuggggauuacaauuuaauaugagauuuggguagggacacagagccaaaccacaucaggugacaucccaguaaugacuguggucuaguaaauuguguuguguugauguugauuuucagguuuugccauuguauuguauguauguaagauguauauaugggggaagcuggaugauggguauaggguguucucuguaccaguuuggccauguuuugugaaucuauaauuaguuucaaauaaaaguuaacaaccagaagaucaugagcuaaaccaauaaagugaauuauggucaguugcagauucacugccagaccugggaggaaaucucaccuuggcagaucgagucucuuguccucgccuaacaaucagcaguucaccucucgaaaagggguuccguuugcaaucugucagccacuaccuucuuauuuagagcaugucccacuacaaacauuucuauaaaguuacuaaguuuguuagacaauuagaauugcaaacccccaacacacacauaaacacauaugcacacccuaauuuaaaggcugcauuuuccauccccuggacuuacuguauugccuccaguuucucuccauuucucaggauugguagcagaaaugggaaaccugauaccuagggcaagagaauugccugaauaacaguguguggacuugaaucacuauccccaggagccuaguaacccacagcuuguggauuagucuguugaacuacuugauggcuugugaccccuuuuucccuuagaguuauauguucugauuuucuucuuauugauaguggcagcucugugcuuuauuuugaagggaagcaggggaaccaaaagaaaacuuagcaguuguaaguuacuuacagagaagacugggcuaguuggcugugcuaucauuuuuguugaaauacugcuuuggggucgccaucugggaauguucuuccuguuuuaugggggaaauacauacaugcguuuuuauaauauguagccugcauaucccuugggguuuccacugggggcuuggcugagcagagcaauuucuuuaccacccccuccacagcauaaugaauggcugccuuuccucuugugauacauucacauuucuguaagauucugcacguggcagugagugucaugcuccaaguaaaacgaggcagggaccagaggacuuaggaugaggaugaaaggucacuuuguuugcugacucugaaugucagguaguuguguuuaugaggcaucagcgucucugugggguauugaaacauuuacacuuugaaaauauuuuuaaucaucagauaaauaucaguuacucagacagcuuaugaggguucugcuccucaucuggagguacacaccuuucacggggugugacuucaccacaugccuucaauauucuugguggcaguugcccucuuuauaggggggauguggcgucaccuuauagcagacccucuagcucuguuauuuccugaacguaggaaacuaacaacccacgugugggcguuuuccccuuuuccuagaucagguucauguuucuccuccucguuccaaaaucugcacacuuuggcaucugccacuguuacccaagaccaggaauuuaaaucuguguuugccaguuugccuccaccacugaugugcuguugggguuuggggacauaauuucaucacuuucuaccaccuuuccuuaaaacuaggcuuugugccaggugcgguggcucacgccuguaauccuagcacuuucggaggccgggguggguggaucacaaggucaagagauugagaccauccuggccaacauggugaaaccccgucuguacugaaaauacaaaaauaagcuggguguguuggcacgcaccuguagucccagcuagucgggaggcugaggcaggagaaucgcuugagcccaggaaguggagguugcagugagccaagauggugccacugcacuucagccugggcgacagagugagacuccaucuaaacacacacacacacacacacacacacaaaagcacagggcuuuguuagcaggcaugacuuggauucuuuaggauccuucccucaguaaucuggucugauguggccuucagggaggaucuuuggacaucauugccauccaucuguccacugugcuggacuauaacccacccagacuaccauuuauugccaaguggcaucgggacaagaguuuuacacaagaaacaucuucucugcuaguuaaauuaauuagauaauuugucuuccagacaggauguuaggaacuuaugaacauguaucguuacaaaccuaugaguagaugacuaauauucaucuuuuacagauaaggaaacugaggcucaacaguguuaaaugguccagaaugaguguguuuucuagcugucacugccugauguuuacugcucaaagcuuaggacuuggauuagagcccaggacuuggcagccaagauaaaccagcugcaauuacgcugaacgucucagcccagcuccuguccaucccugaacaggacacuuaggguagaggauguucucagcagugccauuugcaucccccuucauagccuuacagguaucauguuauccuccuuaaucuuacuuaagcaucacagucuagacuagaauucccaagucaaccguuuguuuuacgggacucuucuuauuugaauaggcagguggcccuguguucuuggguuuuuuguccuuucaaggagcuaggucuaagaagugauaguauuuaaucucgcacuccgaagcgcacccagauuuaaaaguugggaguggcccauacacagaaggcuagugggaggggcaacccggagauuuguccuugcagaaugaugccaugaagaacauggccaauggaacaccauugcuucaaaucccgaccucuccaguucuccugguuucuugcuaggcgggaacuugggcuucuuuaucagugacuggggucaguucuuguacucaauuuccuaucucugugaucucuuguaagaugcugcauugucaaauggagaaaacauugucuuugaguuguuaggagccuugagugagaugguaugcaaauguccagcccguggcaggcccuaaguacacaguagccauuauuaccauuauuauuccuaucaccagcauguauuccaccuguugauagaguuuucuggguuuacuaagccaggguguugccuuugggaucgagguccgucagaauccauugguauaaacgagucuuucugcuuuuguacuuucuauaaaggaguugucuuugauuuuugaugcagguuuaauggagauauuucagaaccuggauggcagcuuuugaaauuaagauauuguccauugcaucuuuccaugaucgaggcguugucgugcauuccccuccuuacagcguuuuaggaugcagauugagaggagauaacguuagcccgaagcgccuuugcagccucuuuugcgcggcugaaacacagcacaacccacccccccgccccaccccccagccuguagguuuagcagaaucccagccucacauccuccccgaacuuggcaguaaaagcccuguucuuccauucauuccgaugauuuauauucucucugggcgucuuauauuaaacaggggaauuccgacauguuccauaacacauuuacuguaacuugauaccaugaacuacacuugcuguuauuuaucauuucuuuuuauuuucucucauugcagcauaaagccaagguagaagcaaugacccuggaccucgcucugcuccguagcgugcagcauuuugcugaagcauucaaggccaagaaugugugaguguuccaguggaggguuauagaucauaauuucuugcuauuguaauaucuuuaucagaugaacacaauugggagaaugcaaggcuguuguguugucuuggcguccaaacaggaggcucauuuauauuggcccuguuaaggugaaccguauuuucuugacucacagucaccuucauuaugagaugugucaucaaucuaauaacagcuucccacauaccaaaagagaagacacuauuaaagcacuaguaaaaguggcuaauaaaagcuuggcaauaguaagaugcauccugauuauaagauuuuuuguagugcauuucagaauggaguaagaguauauuuaaauugcauucaggaacaaguaaacucaguuauccaguauggcagggagguugacaauccaagcacccaaaagaccucuaguuucuaaagccuucgaugauuugaugugguacauggaugugguuccaaaaaacauggacucacauuccuuuuauuuauuuuuuuucauccuuuucagucuuucaaaauuccaguuggagaaagccuuaguuagggccuagcauauuuugauccuaucauaugcuagcaucccuuucuaacagagaagguuguaggagaaagggagagaagcggaaggggguggggagacagagagacagacaggaggccucaaacccugaaacacugagcuaaggaaagugaucauggcaagcuacacuaauuacaauacuuuguuuccaaguguuuauuuuuacucauauuuagggcaggcaauccugguuucucguugaacauagagguuugaauuucauuaauaaauaacuucauuuauuuuuuuucagugacuugauucaaacaugaggauuaaguuaauaauagcacagguugugcgaaggauaagauaauuacacaagaggcaccagaaccacugaauguggagagcucucauaaaugacaagcugccuuuggguuaggcucuguugggaacauuaguucugcaguguugcaagcagaugaaggaugugagggaagggaucuuaaaccagauauucaaauggcccuguggggagcugacaccacacugcugucuaguguccaauucuccuugcauggcugugucacccagguuggaacguagugcacaaucucgccuuaaugcaacgucccacugugggcccaagugauuuuccugucccagccuccugaguagcugggacuacagaugccugccaccauggccugcuaauuuuuguauuuuuaguagacauaggguuucaccauauuggucagacuggucucaaacuccuggccucaggugauccacccgccucagccucugaaaaugcugggauuacacacaugaaccacugcgcccagccgcucuacuuuauuagauuuaaaaaguuugcucucagcugggugcaguggcuuaugccuguaaucccagcaguuugggaggccaaggcggggagggucaugaggucaagagaucaagaccauccuggccaacauugugaaaccccaucucuacuaaagauacaaaaaauuagcuggguguaguggugcacaccucuaguccuagcuacuugggaggcugaggcaggaaaaucgcuugaaccugggaggcagagguugcagugagccaagauggcaccacugcacuccagccuggcgacagauugagacuccgucucaaaaaaaaaaaaaaaaaaaaaaaaaaaaaaaaguuuguacucagccuggcgugguggcucacgccuguaaucccagcacuuugugaggccgaggugggcggaucaccugaagucaggaguucgagaccagccugggcaacaagguaaaaccccgucucuacuaaaaaugcaaaauuaacugggcggggaggcacaugccuguaaucccagcuacuugggaggcugaggcaggagaauggcuugaacccgggagguggagguugcagugagcugagacugaaccagugcacuccagcccgggugacaagagcaaaacucugucucaaaaaaaaaaaaaaaaauugacucaggcucuugcuggaguaugucagugucccaagucacugaggucuacauuagagucagucuuagugagaguugcaacaucgccuaagcgcagaccccaagcuggcuuguaggaacagugagauaacaucccccagccagccagaucugagagagcccuccuguguguguccuuugcagcgcuuggcuguuaguagcuuccacccuuugccagaacuaucaagaggcaccucaacaggcugcaacacuagcauucaagacauuuguucgcugauuugcuucgucauucauuuauccacccguuccuucacuucacacacauuucaggagcaccucuaaagccccagacauucuucugggcucugagaagagagugguggcccuggaagccacaguaaccgcacacaagcugucaccucaguugucagcuauuauggauggcugacuccucaaacucaucugucugugguuguuugggagggaaugauaaugacaagaacagcagcggagucagcagcucauuuacugagggcuuaugggccauacguggaaaauauuuugcauguauguuuugauucaauucucaaagcaguccuugggaguagaugcuauuaauaucucuacuauacagauaaggaaagugaggcuagagaggauauauaauuuauccaaggcauguggaauguggguagaggggccgauuuagccucuucacggcuccaacuugaccaccguacuauacuguguuucauuuuaguuuauuuuuuauuuauuuuuugagacagggucucgcuguguugcccaggcugaagugcaguggugcaaucucuguucauugcaaccucuggccuuggguucaagcgauucucaugccucauccuccagaguagcugggauuacaggugcagguuaccacacacagcuaauuuuuguauuuucuguagagaugagguuucaccauguuggccaggcuagucaacuccugaccucaagugaucucuccaccuuggccucccaaacugcuggaauuacaggcgugagccacccugcccgacccuuucauuuuaaaugugauagaaacagacucagagaaugugagugacuuucgcagggucacuuagcagguuggugacgggcaugggguuucacuccagucugccucuuguucuuuuccucauagcaugugagaucucacaauucacugccgcugaauaacuuuguccaguuccucugucagaauguguuggaagugagcagcuuugcugaagagagccaacuguuacauaauaggaucaucuuccacgucuuaacuggaccauuaguuuuuaaccauuaaguaguugggaaaucaucaaguucaagugccuuuuguaaucaccaagcucaaaaccuuggaggaaacucucacccauuuugcccuaaucccagauuuuagcacaggacuuuggaauuuuagaaaguacuucuagguugagaaacaagggugauuuuccauauagagaccucuguagcacaacccucuuuguaugugucccaugagaguacaggauuuuacauggcuuagagaaauacugugguggugaaaauaugcauaaaaaagcgagagauuuuacuuuugaaaugcugccaaagugaaaucucucuuggauaggcagaugacaguuuaguacuugcaggucuuucgauucugacaacugucagaagugaauuuaagugcuggugacuaggcugccagagaaacacauguaacucuauucuuaucaccccccaucuucagacauuaaaauuuucuuguguguaaaacauaaugacaaaugaaagaaaggcugccaguucagaaccaaucucuuuucacgcuguugcauugaggagaggaaaaaaucccuuaaauuugaauuccauguggaugcucuuauuuaauaugccguuucaaagccuguaugugaucaagccagaguauuaucaggcucugaguuccuguguguauucccuugguccaugcuccaucucaaguguuucuccacacugggauaggcagcauauuguguagucuuagagcagaaaagguagaaacagauucuuaguacaaacacuggugagaaaagcagcauauuguacuguggaaccacccgccgucugccuucugugggagauggggaucagccucuuccuggaucucuucuuuuuauucgggugcugggaggugaggcugcaaaggaggcuguuguagagggagcccuccuaaccaugauuauguaaacaauagcugcuaggcaacuuguuguuuguuuuaugcaaggcagugugcuaagcacuuacauacauguauucugucuguaguuuguuauaagaguccugcacacuuaaccaugauuaucccuacuuugcaaauuacaagguugcagugcagagagccuaagacacuuucucaacuugagcaaguaggagauccagaauuugaacccaaaucucucugaauccaaaacgacuuuuuguuacuuugcacacuucagucauaggaauuucaguguggauuucuguauugguuauguauugccgaguaagaaaugacucuggccaggcacgguggcucacacauguaaucccagcaccuggggaggccgcaguggguggauugcuugaggccaggaguuugagaacagccuggccaacauggcaaaaccccgucuguacuaaaaauacaaaaauuagccgggcauggugaugcauaccugaagucccagcuacucaggaggcugaggcaugagaauugcuugagcucuggggugggcagagguugcagugagccgagaucaugccugggggacagugagacucugucucaaacaaauuacuccaaaauuuaguggcuaaaaaacaacguaaaacaagaaacauuucuuuugugccuccucuuuuccucccucccucuuucucauaguuaauuuguuugaaucaggauucaaauaaggucgaugcauuuuuaaucuauagguuuugucuccuuuuuuuuuuuuuccuuaaaaaaauuucuuuuaaugcaacagauuuaagggaccaggguguucucuagagcagggguccaugaccucuaggccacaaaccaauagcggagccguggccuguuauaaauuggguggcauggcagggagugaguggugggcaagcauaggaagcugcgucugugcuuagagccgcucucugucacucucauuagugccucagguccucccccugucagaucagcaacagcauuagucucauaggaccgugaucccuauugugagccacacaugcaagggaucuaggcugcaugcuccuuacgaaaaucuaaugccugaugaucugucacugccucccaucaccuucaagaugggauugucuaguucuaggaaaacaagcucagggcucccaccgauuguacauuauggugaguuggauaacuauuucauuauauauuacaacguaauaauaauagaaauaaagugcacaauaaaugucaucugcuugaaucgucccaaagccacccccacuccuuugagucuauggaaaaauugucuuccagaaaaccacuugcuggugccaaaaaaauuuggaaaccucugcucuagagauuucugcagucuguacuuuggugauugcaucucuguggugucuuuuaacauacucuucugucuccugaguuuccugugaaaggguagauaacucaagagacucaaucaacuucguguuuaauguuuucguaagaauacuucagaggcagugguguaaucguccaagaguacacacaggccugauugccaaagccaguuuucuucaggcccagcacguccugaccuccucacuccucugcccacucucuguuuacucacucccauuuucauucauugauucuguuauucuccacuaaguuuucuggguggucagcccaggaagccucagccugcuuccagauaguucuccucagaguuagcgguagcagcggucgucggccagugugucucgggucaaauuauuuugggcauuacuggaaaguuccaaaccaaagccugugguaaguuccacccaaacuggcuugugagggauauuuuuguuuaaacugcauuccuggagaggagccagacuuccuacugccuggcagcagugguguccauaggaguaugaagagcugggacccuuucuaaucacucagaccaaauauugggguuuucugaaauggacugagaaauaacaguauguuuuuaugaggcuuugcacauuuuccuuccuagcaguagcugcuuagucuacugaaaagugcauauuuugaacagggccuagaagaguuaacagcuccuagagagaggugcucuguaauacuuuuucuucuucaaaaaaugguuuauggcugggcgcaaugguucaugccuauaaucccagcgcuuuugggaggccaaggugagaggauugcuuaagcccagaaacgugagaccagccugggcaacguagugagacgcugucucuauauuacaaaauuuuuuaaaaaacgguuuguagguccuuaagucccugauaaaauagagaacugaauugcaauccuggaacuuaaaaaguuggugacgacaccugagauauuuauuacuuagauugcaguuacuggucagcuuguauaauacugaccaaggguuuugauucuuccuggaauugauaggaaauucauauuaaaauaauuacccaaguccaaacauuuuuagaacugcauuuuugaucauggauuuuuaugucucuucugaacuuucugucaccgguauaauuuaaagaaauuauacuuaagcuuugucucacuuagaagauaauauagaacagugguguuuuuuuaauuaaaaaaaagguuaaaauaacgguuuuguauccuugcuuuacuucuuaaacauaugggaggaaaaaaaaucuuuaacaaguuuauuuauuuucauuuucugcuaaauuacuuucagaacuugaaucuacuaaucccagauauaauauucuuggauucauauuccaaauuuugcugucucaaauccaucuagggaagugggugggcuauaaauuauaaauaaauuccaaauuuugugggaugaauuacccugaagaccaacguguaaauuacauauuaaucuuucuuuuucucccuagcucgguuuuaagaauaauguuuuagccaacauaucugcauuacucuuggcucaauaugagaaauccauuuuugguuugccuaacagaagaucaucuugcuuugcuucucuacacaguaugaaaacccaaagaaaagaaaaacagaggcaguuuuuugcucuaaugaaugcucuaaaucuagcucuuaauuaugauuuuuuaaggaaaauuuugaaaagucuacaaguuaaauuuuuuuuucuaucccauacauuuuccauccuaaggcauugaaaaagcacacugugaaauacuuaguguaucuagaaacaucagggaagaaugcuucccuccuaagcaaaauuuugccuucugaaacuuuuucagcauucagucuuuuuauauaauacuuagaaaaauauuucugaaauagaucauacacucucuucccaaaaacaucaaaguaugaccguaaagggcagagguagguaaacuucuuguaaggggccagagagugaauauuugagaauuuucagacuauuaagaucucuguugcaacugcuugcuuuugccgugguagccugaaagcagccauagauaguauggaaauggaugaucauggcaguguugcaauaaaacuuuacaaaacagacaaugggccagauuggccaggggccauaguaugcuaccccugggcaacaaccuguaugcccuggaguaguguaaagaacguggguguugggggucaacugacgcuuccagcucuaccacuuacuggcuguguggcuuugggcaaacuacugaaaaucucucagcgucacuuuccaaguguguguaauguguauuuucacagugcuuugcagguuguugauuauugaaaauagccauaaugcaugaaauuaccagacacaucucacuuuauggagccuggggcuauugguaauaugcauuucuuucucaucuugaucguaaaaugaucuuagaaagguuucugagaauauauagaguuuaagacagcaauaagacaacuaauuaauuaaacaggaaaaggggauguugugcucagagaggaagugugggucucauaagggcuuucacaaucguuugagaggacacgugugaugucucaugccuguuaucccagcacuuugggaggccaaggcaggcagguugcuugaguuccggaguuugagaccagccucgguaauuuggcaaaaccuugucucuacaaaaauuacagaaauuaguugggugugguggugcacaccuguagucccagcugcuugggaggcugacgaguaaggaucacuugagccagcaugguggaggcugccaugaucaugcuacugcacuccagccugggcaacagagccagaaccugucuuguaaagaaaaggaaaaagagagagaagggcagaaagaaagaagggaaggaagaaaggaaaauugggcccaggaaugaucuuuacaaugccugacaaccaagagaagaagggaaaugagcuucacauugccugcaagcucuagggugacaagagccaagagaaauuauuguuacuguagugauguuccacugaggaucauaaaguacuuuauuacucuacugaguaugguuuuuuguuuuguuuuuucuuuuucuuuuucuuuuucuuuuuugcuauucuuuuguuauucuugauuuaugcugauggaaagccauggacccaaggaugcuucacaguuuucuuucggaguaaaugcuuagauuccauuuucuuugacaugacuaugucuguuccucuugauuuuaggcaucuuuuucagaugaguugccauaaaagcagccugcucuggauaagugagguacagcaggacacacugcaaauacuaggaauccuuaaguacaguggaaccccagagcacucuaccugcuuucuuucucaccuccuuaaaaacuuuuuuugcccucaccucaucauuuauucagcagucacaacagugccaagaacuuggcuagagauuggaaauaaagcuuaugccuucucucauaucuccuguaccuuauuucuuucuuacaguaguugugaugcuuagcaguuuuuugauaacuuuuuaugaugccaaccuucaaaaaccugccccugguggagagaauaauuauuacaucaauuaggggucacuuagcaugacauuugucggaaaaaaaaaaguuagugagccuuuuugccauauuaaaagucaucacugccaagacauaaaugaaaauguguucgaauuaaccacaccaauguucacaaaauaaacauuuuugauuucccaacagaauccuagguuuaacuaucacuaucaucuuucaugaaaucaaagucauauauguaaauugaacacaacuuucccuuccauagagaguaaaaaccacgcuuuggaggguagauacaauuaccccaggguugucuuuucccacuccucacaaucccaccagugcacaugcaaggugauguccuuccuuuagcuauagcaaauaauguuaauuauuguugguguuaaauaaugauuauguaaagcacuagacuagacauucgucggcaaaguuuuucugcaaagaaucagauaguaaauauuuuugcucucaucagccagacagucucugcggcaaccauucaagcauuguugaauacauuguugaguguuacaugagacuauuguaauauaaaaguagccugggacaacacauaaauaacuggguguggcuguguccuaauaaaacuuuauuuacaaagaacaggaaguggcuuggauuugguaucuggccuggcagcugugguuuacuacuccuuggacgguggcccagagacccuuuaaaugaaauucauuuuacuagcacccuuuuucaucaugagaaauauauucuguuuuucuuagaaaauggguuauguuaggucuggucaagguaaauaaguguugagagucgauguugugugcauaguuaauuucaauucuuugaagaaacucccccaugauauuucacggcugagagaagaggaaagaguuuaaguggaacagugugcuuugcugagcuuuggaaauauuaccauauagggaagcaggucaauaagacaacuaagugcuguuucaauaacgaagauacugaagcgcuaauuggaguauggaaccauauaaugaugauaauaauugcuaauauuuaucagcuauuuaucaugugucauguacagcuaagcacuuacauaccaucccauuuuauccuuauaaugacucuaagaguggguuaaaaaauggcagaagaauggcaguguuuaaugguucagccuggugcaaugauuaaccacauuuuacagacuaagaaauuaagaaccucaaccaaguucaugcuagcugguacgcaguaaggcuagaacuucguccaaaaucucuucuucuguugagcucagcuugcauaguagcuuggagaaucagaaagaucugucucauuugggaaauauaccauguaaaaaacauuguuucuaaaggagauuugucccaugaguaaaauagaugauggacagccacugccuagugggacaauuagaaaggucaguucaagguuggaggagaugcuucuuucagccaauuuuccuuuuucucaggaucaccucaggugauccgcccaccucaaccucccaaacugcugggauuauaggcgugagccaccgcuccuggccuuucagccaauuuucuaucaccaaagggaaaucguuuugcuggaauauguguaaaggagguuaaagucagaagagauucucguccgcucaguuaagguacucagacuauuuuccaaccaaucaagagggugcugcuucauggaguucguuuaagcugaagcggcagcuguugacugucauuugcaucaucuuuauacauuuacugugaaugucacuguccauuuccacuuucuuucuacuugucuucaaauugaugcuuaucaaguagacagaagaagaccaaggggucguuuugcuauuuauaccuccaaauugauggcgugaucacucucaagugcaaacccagcccugacacuguccuguuuggcaauguccugcuaucugaccugcaaauagcuacacuuccugcuguggcccacccaggccucugggaucugaucccuucucccaugucaccuguggccaugucuuccccaacccaggcuucucugcuccgcugcuuauguucuggauccugacucugagccuuugcuuguguggcuccucucccacuuguccaucaucaugucaguuauguaagcauagauuccaaagugacaaugaggguaguuaggauggcaagaggagaaaaaccaagcuggauucauggauugcuugugucacguccucuacagagccucccuucuaccugcucuuacccgggcaccacaguugaugaguuauuuuuuggaccaucagcaacacacccaaucauuguacauggaauacuucggggaugcuuuuuucuauauugauuuuacuucauuaaacugagcuccagaggagcagaaacuuuggcuaauacaucuuggucuuagcuuguaauaucugugcuacaacuuauuaagauggugacgcuggcaaauuccuuaaucuuucuaauucuuaauuucaucagcaaagaugggaaaggauacuaacaccacucuggguuguugagaggauucaauaacugaauauuuauaaagcguaguaccugauacuuaauaaaaaagugaauuuuaaccugugucaucauugucaucgucuuuaucauccuuugcaauuauuacauuuacugccuucuaguacaaggaaggggauggguggcuggcuggcuagguggauagaaggauggaagagguaaguacaaggaaggggaugaguggcuggcuggcuagauggauagaaagauggaacagguaaguauaaggaaggggauagguggcuggcuggcuagauggauggaagggguggaaggggaugcaagagguaaguacaaggaaggggauggguggcuggcuggcuagauggauagaagguuggaagacaggaaggauggaacggaagaagagggaagaacaaaaauggaaacacauaguacuguuaggugaacugaacuucuaaggugccgauucucagugauagaaucuugaguugauaccuccuuggguggcauggagccuauaccuuuguagaucuugggaaacaacuucuaaaguaaucauaguuguauguaaucguaguuacaacaauaguuauuuuaggcacauaacccaaagguuuucuuacaaggaaucuaugaaccuuaagagugagggcuucuguuaagaguaagggcuucccuggaguggacauggaucaugggacugagccagcuuggcauuguuggguugaacagggagcgacaccucucagcccagucuaucaagccugcucuuugaccugcagugagaccacccacgcagacaucaaugcagcaaauccccggcgucaggguuucaacauuugguuacucucagagaacucucgauuuauauaagacuuggaaaaaggguuugaguuucugugguuuacaauuauauuucccaacuuggcccaugaauccagcuugguuuuucuccucuuagcauccuaaccacccucauugucacuuuggaaucuacacuuacauaauugacauguugagaagcugugcuaaaaccacacugaaaucacauuuuaauaacaugggaaccaucuuuucccaguaaauuguugagaagcuaauucuugucagccuaaaaacuugaauauacauuugaauaaaucagcggugcuacaccguggcagccugcugaaaauccccaaggaagauuauauuuuuaguugagcuacuugucacugcacuguguuuuuaauauugugaguccuuucuugucuucauuuuugaagaaucuauugcauaccuugucauucagaaaaacauaaacgggaccucucaauuagcgguaaaguucgucaguuuaacuuuuaagcuuaaacuccuguuauaguucggucacuuacucgucaucaaaaagauauuugagcugauauuaugcaauaauuuauaaccaaaaacaggaggaaaaggucucuguuugucucagaaguacaaguuaugcauaaggugacaaauuacacagcuuugggaaaugggucuuaauggaaugcaccaggcuaauagaaaagcagugccucgauuucccaccucagaucugaaaacuccugagagacugacagggcgguuccccagcuuggcugugugaggaaucagcugggaaucgaacacugcagucuggcugucacccccaggauucuaauguaauuguucugcauuguggaucgauggauggauggaugaauggcuggacagaaggaagacuuggaaaaaaucuuugaguuucugugguuuacaauuuuauuucccaacuuggcccaugaauccagcuugguuuuucuccucuuaccauccuaaggagggagggagggaggaaaagggggaaggaagcagguagaaagggaacagggaagggaggacuggaggaaggaaagcagggaucauucuggaguguacacugggcauuugauuuuaaagcaaauccaagagaucauuaaauuuguaucaaugaauacacuguuaccccucaaucaacacuacaauucauauaucagaauagcacuuuguuacuuguuucugagauagggcuggcucugucacccagacuggugugcaguggcacgaucacagcucacuauggccucagccaccaggguucaagugauccuuccacucagccuccugaguaguugggacuacaugccugcaccaucaugccuggcuaauuuuuauuuuuguagagacgaggucuccuuguguuguccaggcuggucucaaacuucuggaaucaagugauccuccugccccugccucccaaaauacugggauuacaggcaugagccauguccagcugccuuguuuuuuucuuugaagagaaugauagaccuuccauaggaaaaauguuaaauaugugugugcagaaauaaagauuucaaauauuuuugcaagauauuuuuucuaauaccacuuuuuucuacauuuuccauaauuuagugaagauaguaaauuaacaaaguggaaaagacugaauauuuuaagaaaagccaaguuuaaaaauuuugaaccuaauauuucuuaaaguagcuaaaauucagauauugagaauaaauucaacuugacauggcaaaauucuaauaggcugaaauaauguuuuggucuagaacuauguagcuuuguguagcccaucaauugucuaaaaaaagaguaaccuauuuugaugaaacucgcuguaucuuguaaccuguauccugucuugguauugugggaguauauaugauuuaggggaaagagucuggagagaccuuaagucugcuuuagggaaagggugaggaaccccacugaaggcuacuuaacgcauuuugagaaugucaguaaagauuucucagagcccagggauuuuuuuuuuaauugagacauaauuuacauacaauacaauuccuuuuuucuuuuuuuugagacggagucuugcucugucgcccaggcuggagugugauggugugaucuuggcucacugcaaccucugccuccuggguucaagugauucuccugccucagccuacugaguagcugggauuacaggugugcgccaccacgcuuggcuaauuuuuguauuuuuaguagacacgggguuucaccauguugguuaagcuggucucaaacuccugaccucuagauccgccugccucuguaaucccaaagugcugggauuacaggcgugagccccuaugcccagccaaaauucauuauuuuaagcuguacaauugagugauuuuuauuacguucacaaaguuacguuaccauuaccacuuuugaauugcagaacaauuucaucacuccaaaaagaaaucucauaacaauuagcaguuauuuuccaucgcuacuuccuccagucccaaggcaaucagcagucugcuuucuaucucuaccuguuugccuauucuggacauuucauaugaguggaguuagauaauacauggccuuuugugacuggcuuucacuuagcauaauguucuagagguucauuuauguuauugcaaaaaucaguacuucauuucuuuuuauggcugaaaaaaauuccauuauguagaugugccauauuuguuuaucugguugucagucggauauuucuguuguuccuacuuuuuggcuacuguaaaagaugcugcuaugaacauuauugugauuauuauaccuuauuuguaaacaucaugggugggggguugcaguaaacauguuggaaaguaggguuggagguccguagaaauugggggcuucagcacuucccccaagcucaacaccaacccccuuucugagccccucuugaaggagaguucccugggacgugccugguauugguacaaucagucaggaagcauuuuuccuggggagaaacuuacaaguccacgaucaaagccaacaagagacaagguguuacaugacucauuuucgguuuaagaagugacaggcugauucuaaguuggguucaauuauuuuguuaaagcguuuugcuuauuugacuucuccugaccucggaaauaauucuaaccaaucagugcuggcucccauuggcccuggggucugguugcuuuacagcuggugacagggggaccacuccacuaccacaugugaauuaauccucaacuccagagccaagugccauucuccagcaagguuguauuucuucauuagcuauucccagggcccagaaagucccagaggaugucagaguacauuaauuuuuaucauaacauggaaucuuucaggucugaauggcagcacacggcugucaggggcuucugaacucuauuacagcuccauauaucucuaggcaaaacagaggaaagagucgucauuggcaagggagauguacaaaaugcaugagauguuuuauuuuuugagugacuugaccacgugcuuaagcacauuccccaaacaauuuuuuucuuauuguuuguaaguuguaaguuguaaauucaccucugccaccaccuauuaaagcccacucccugcauuaaaacuguauaaaguguauuuaaauaaacucucuuugcaugaugugaaugaaaucgucaucugguacuuaaaacuauucuauaaaguuauuaaaaaauuaauguucccuucccaugauuuuucugcagaauuuaugcauccaugauacugcagaaguucauaaauaauggcuuguauugcugcuuuaguauugcuuuaugccuacgaaauauaauguuaauuuguagcaaugcuaauguguuuucaggaaggcucuuuguuuauugccuuuauuuuccccacuuaccaaguggguaaaaugcuuugaggguugcauuuuauguauucaggaggcccagguauuauuuuaauagaagcacuauugacaaauaccagucauccccccugugccaggcccuggaugaggcacugcuucgcaugggggcuccccagauugucccacaaggaaagcauagucaaagacaaaguuuucaguuguaagaguaaauguguucugccuaggcauugucaaguaauuuacugccagcucuagcccuucacucaaguuuccuggauacuuuugacuucuuagccauggauguguuugaaggcugcauggaccuucacuuacuugcacugcaggucagccuaauugcaugagcucuguggaccacagagcaggguuuuccaaaguucaccaagacaaauauuguauuaucuuaacauauauucauuuuuuaaaacugaaaaucagaagagcaacuccaccuagcagaagucuuuugcaaagggcgaggcgaggcuaaaaaguauagaagaguucguuuccagugcaauuuuauaaacacagaugguccuuaaauuaagcaaaugguaccuaaaugacuguguuguggauaaugguaacagagggagggacucggggguuuuuuaaaaaguacugauuguaugcaguguuuuaaacagauaacugugaucuuagugugaugaaagaugcugggagauuucaccagugguaucuuauuauuuuucggggauuuuguaauucaacaaaauucuguuguaugccaagcauaacccuaggugugagagcacaaggugacuucagauaccaccucuauccuucagggguuuggggcccauuauuaugacuuaauccauuuugggcgugagaagcugagggucacagaaagaaccaauucccucuuuaaauaaugccaccccaacccuccucaucugccaggucuuucccuucuucuauuuguaugaauaauagucacuuucucuuguggaguucgcuaaauucuacuuuggccuaucaaauuucuuucauaucacaacuaaauuucuuaaggacgggacuaugguucauuugucagacgaacaaaugggaauuugccaagagacacuuggguuaauuuacgucuuuuccauccaagggcacuauguugaagugaggcuaguaggucaugagugugguugaaguuacuuuuucuuacuuucccgaccagcccccauccuuacugcacuuaaaguugauuguccauuuuauuaaauguccccaggaagccagaacacagggcaguaaagugcugaaugcaaagggcaggagaaaaauggaaacaaccagaacuguaacaccaaggaaugagaccugcaugucagauaucaugcccauugcacuaagugccauuggggcacaauuaucaaauggaugcauuuucccuagaaaaccaucuuggagagcauguggauguacuucuauuuuacauuucccccuauuuacaaucaaugagauugagauuuuguugcugggacugcugaugaugggaugggaaaauauaaucaagguaauggacaugaggcaaaaauuuaaggaaaugacaaaaacaagaguauuuccauuuucaguuaaguguauguacugauguucuggaauucacuauaagaaguugcaaauggugcaugaaaugaaaaauuccugguggucuccaggggacacagccggugcugugcuccacucuggguaacuguuuuggauuauuuucucuauuccaacugaaauaaaaaaaaauuaauuaaauguggcuagguuaucuugacagcagaauccauucccaguuaauuauuauuuuaauacuugauggugucugucaaauugucgacaugugacgguccuuucaaauuuaaaggaauagcugauggucacuggccacccaagcugauacugauuuuauauguugauguuucucauuuuauuugcucuuuccuugaauauuuauucaggacauucucuaccagacauauugaguaagggcaacagaaacaauacauaaguaucuuauaaauguggaaaacaauguauauguguuuuuuaucucucaaugauugguggguaccauauccccaaaguagaaugagcauuugagaaaacaggaaauauccucuuuuaggcaccaucucugucaaggcugaugcugggcuuuuuauauauuuucucuaauucuuguggcugucaaacaaggugggcauuaucauucccuuuauaggggacacagcuguggcucagagggguuuauucacuuuccugagggccacacacauaaugagaggcagacacaggugacgaagugaguuuucccugucacgccaucuuaucugucacauaccucucugacaugcuaaaauugcacuaaacaaaagaauucucuuaugcacauaucaugcaaaagauauucuuuaacuggggaucauguuucucauuccaucaauagaaugacuaacauuuucugagggugucucacgugaaaguaaaucgcucauguuuguucuuuuuaaaagaugcccuucguauuguguaucuugcagucuugcuuucucaaacuuaagccaacuauaucgucauuuuugcaaaaucacugcgucaguuuacuauuauuuaauguuuauugcuaccaauuuuaagaaauccuuuauaggacuauuugugaaauugauuuugugaggaugaugauauaauuuccauuacauuacagcauauaaauauaaauauauauauauauauauauauauauauauauauauauauauauauauauauuuuauuauuuuuuuuugagacggagucuugcucugucaccaggcuggagugcaguggugcaaucucggcucacuguaaccuccgccgcccggguucaagcgauuccccugccuuagccuccugaguagcugggacuacaggcaugugcuaccacacccagcuaauuuuuuguauuuuaguagagaugguuucaccauguuggcgaggauggucucagucuccugaccucgugauccgccugccuuggccuuccaaagugcugggauauacauuuuuuuuuuuuuuuugagagauggagugucacucuguugccgaggcuggaguguaguggcgcaaucucggcucacugcaaccuccuccuccgggguucaagcgauucuccugccucagccuccccaguagcugggauuacagucgugugccaccacgccugguuaguuuuuguauuuuuaguagagauggguuucacuguguuggcuaagguggucucaaacucaugaccucaagugauccgcccgcuucagccucccaaagugcugggauuacaggcgucagccacugugcccggccggauagaaauaauuuuuauaaacuccuuggaugcuaccuaaaaucaucuuguuuugcuaguggcacaugcugcauuuugggcagcuguggccuugguggauugcugaaguagauuugaccuuaccuggacugaggcagcuguugaagggaauugcuguguucaguguauacugccauccaugauuucaugaaaccagcucuagcuauuuaagcaggggucaaacuuagaauucuacauuauuuuuuucccuuuucugggaggaaagacaguugaacaccagcaaagacuaagaaguuucuuagaagacuguggguccuugggcccuuucuauugaauuucagaguauuuccaaauacuaugaagucuugcagcuuaguugagaaaugccccagauggugugacauucugcuuccaggagggauuggaaaguauuuccuuuuacauaacauuccacucagcucauuccuuugcugugucugaaauugaaucccccaaagccacaauuaucuuaacauucagaagaguguuuauuuaaucugcaaaaucuugccucacuuuuggggagcauguuaacaauuucacuuacaaaucuucuguguaacucaaccccaugguggugucuacugcugcuccuagacucuuuaaagcaccuuucucaucucagguuugaaaugauaugucucauucuuggguuccuugagucguaauggguuugucuugucuccacagcauaaaugacucuuucuugaucaacuagaaccacaucaacuucuucccuccagcuucagugauauauugugaaacauggcuauucaacguccuguagaccaaaugccauaagaaaaauagcauugauucaaacguauccauccagauaccuaaaaaaguuuuacuucuuaccacaucuugagucugggcaaacacgcacuuccuauggacauugauuacugucuacuguagagauaacauuugcacauacagauuauggcacaugguagaaaguguuaaguaauguaggaauggacauaucccaagcaaaauuggaagccaaguccccugucccugcucaaguugguaugacugguguauggugccuuaauggguacuuaaaguccaggugagaguggcaggaggcagccaaaugccuagguagauaggagccggucccuguugaaaccccacuuccaaguugaagacaguuuaaagacugaaagccaagcuacaaguuaaauccucggaccagauugagaacuugucuucuuacuuggugcacucuucugauugauccccaccuuucaccuauuuuacauauuccugcccuucccuaacugguuuccuaugcugucaugcccaccuuugaguguugccuucacuuuaaccuucugugcaugcucacaaaguaauuagcauguacccuccauucugaguuaauauaaggccccagacccagccacauggggcaacuuuacugccuucagguaggggaaccacccccaccacauucccucuccacugagaguuuuccuuuuaguuaauaaauucggcuccacucacucuccauugucugcaugccuaauucuuccugguugugagacaagcaguuggaccuagcugagcuaaggagcagaaagacuguaucacagggaacuuguguaacagcuugaucuccuguccuacguagcuaucuauugguaagaaguugaaggaacuugugucauuccguugugccugucgucuugaccuuguaaaaggucuuggguaagcaugcaagaaguuuugaagagggagauacagcuaauuugcagauaaagagcaagggaagaauuccuggagaaaggaagaguuuccugagucaccuuugggagguaggaaggguuugacauguaggcugggcaucugggaacgagugagggauucugugagccccaucucaguggaccacucaaggaagguggguaagcccuggguauaaguguguaagcagggaacagaaaguacugugauuuaaaauauguuaauuuuucuacuguacagaugagagccagcuuggagaugggcuguagcucaagcaucuuaccuaccucugauuucuuaaugccacguuauaaggcugcugcuuauagcucuugaagucacuccaaaaacagaugagugagacccuguugcuaaagucccacuggguguagauuauucacagauguauacacaguggcucacuccagguaggaugugaucagugcuuuuagaaauacagaaaguccuauugguuuaaaaaaaauuuuuuuuuguaaugaauugaguuuuaaagcuagcacuguacaauaaaagggugaauuucacuaugaauuaugacaaacacagucauagagcugccaucaucacugucaagauacagaacagugccaucaccccccaaauguccucugugccuuacuguagucauaccugcuccugacaccuagccccugggaaccauugaucuuuuuucugucccuaguuguuugucuucucugcaauguuacauaaacagaaauauucugggugucgcuuuuggaguuuggauuccuucccauagcauaaugcaugcaguauuugucuguuucugcuaaauuacccccaagaccuagcgacuuaaaacagcaaacauacacuaucucacucuguuaguuuuccauugcuguuguaauaaauuaccacaaacuuaugugcuuaaaacccaaagcuauuaucugacagcucuguagguuaaagauuugucaugguucucauugggcuaaaauuaaggugucgguauggcucugcugcuuucuagagacuccagggagaauauuuuuccuugccuuuuccagcuucuaaaggucacccacaacaucuucaaaaccagcacuguugcaucucugaccuuagcccuguagucccauuucccucuagccacaaucgggaaaggaucucaggacuguugugaugacacugugcuuaccuagauuaucuagcaugagcucccugucucaaggugauagaguuugcauguuuuucuccugcacaugccauguugaaacauaaucccuaguguuggcggugggugugcugggagguauuuggaucauggggguggaacccucaugcaugacuuacggccaucccuuuggugauaagugaguucacaugauaucuggcaccuuccuuccucuguugcucuugcccucaccauguuagcugccuacuccccuuuugccuuccgccaugacuguaagccuccugaggccucaccggaagccaagcacaugcuucuuguagagucugcagaaucggagccaauuaaaucucuuuucauuauaaauuauccagccucaguuacuucuuuauugcagugcaagaauagcuuaacacacaaggucuuacccuugaucacggucugcagcaugucuuuuaccauguaagguaauauguucaguggcuguggggguuaggauguggacuucuuugggggacuuuuauuuuucccaguuacuauuuuugugacucaggaauuuagggacaguuuggcugguuguuucuggcucagggucuuucuugggcugcaaucaagaugucagcugggggcugggcaugguggcucacuccuguuaucacagcacuuugggaggucgaggugaguggaccauuugagguuaggaguuugagaccaaccuggccaacauggugaaacgccauacuaaaaguacaaaaauuaguugggcaugguggcacaugcauguaaucccaguuaguuggggggcuaaggcuggagaacagcuucaaaacaggaggcggagguuguggucaacugagaucacaccacugcacuccagccugggugaaagagcaaggccccaccucaaaaaaaaaaaaaaaaaaaaaaaguuagcuggggccaaggucaucucaagucuugacuaugaaaggaccuaacaucaugcauggcuguuggcagaggucacuuccucaugagcauuaaacugaaagcuauaauuccugacuauugaccagaggcgaaccucaguucccugccaugugggccucuucauggggcaguugauaacacagcaguuagcuuccauuggauugaguaagcaagagagcaagaacaggagugauacagaagccagcaucuuuuuguaaaccaaucucagaagaauuguccaugauuuuuucuauauucuguuaguuagaaacaaauuccuaggucucacccacccuugaggugaggggauuacacaaaaguaugaaaaccaggaagcagggagcauugggagucauuuggacccugccuaggacagugcguuugagauccauguuauucuauccauuaguaguaguuugcuucuuuuuaauguugaguaauaugccauuguguguuuauauauugcuaauggauuuuaaagagggcuaaucaacguguugauuagagggaaauuuucuucagugaaauaauauuugagcaaaaccuugaagaacaauuaggaauuugacagagggaauggcacgaauaaagacccagacuuaaucaagugaggggcguacucauccauggggcaguggaugauucaccugccuggagcuuaaggagaaggggguguaguuguggcuguugcucagaaggaccugaaugucaggaugcauuuguguuuaauuuagcagacauuuaggaaccauuaaaaguuuuugagaauggguagguaagauuagaauaguauuuuaauaaguuuaacuaggcuuuaaccaguauucauaaaaagucaagugggagaauguagaggugacaagaccaggugugggcuauugcagugacuacaccuaaaaggaacagagcuagaaacauggagugacaugaagucauugucuuagguuggugauccuagcagcugagccugggauggggauucuuguuccuaugaucgauuaggggacuguucccagaggagagcggagagggaagcaggcuuugguuucuacuggaaaucuguuuccgcccgauuccauggggagcucuggagaaggaauuguaucaccgaguugguccuccuugucaacagagcaugugugugggggugaugacuucccagaugugagggugcccuccagcaauggacaguuaucuggaggaguucaugcuccagagguagugccuaccucuguggagaaguaggggauggcacgguauuuuagggguuccuaaugagccuagagauacugacauugaccagucauggagacuaaaggagaagaugggauagcacauuguuuuccuaaguauuuguaaucaggugacugguuugcaaauaucagccauuacagaaauaaaggguaucaggacggggaggagaugugaggagagaagaugaagaguuuagauuuaggcauguugacccugaauuugugggaagguauccaggaagauaagacugacaggugggaaugagauucuggaacuuggaaagaauauaguggcuagagcuaaggguuugaagucuucauggcgauuuuguucggagucauggauuuggaagaaacugcugcagggaagauuuuagagauggaaugaaaagagauuggugauggaacaaugggcaaaagaggaaggguuggaggagacaaaaaauggagugguaguggcauugggagguccaagaguggaugguaucacagaagccaagacaggaaagugagccagaagugagggaggagcaggauccucugcaacagggcagucuagucuuagcagagaggagguugcugaauuuauugauugagaagccacuccucgccaggcaguuuugagagguucuggauggugauagaauggaauucauucagcugaugaugagaaguagauuugggucagggaaggagacugaauggagaugaauauuucaaaacuauagaccauaaaugggaagagagagacgagugcaaccugccuaggucaagugaauguccuuuuuucucuucccagcccuugucuuuuuuacccucuuuguuuucugcauuucuuuccuucuguucugauuuuuccuuaccugauggucagaaagaucugauugagcugacgcguagcaagaaugagccaguggagaggaaaauguaaccaccuaauggguucuccuuuccugcuagcuggacagagcugauuuaucaagacggggguacugcaaauagagaaagaauuuaauccacacagagccagcuguaugggaaaccagaguuguacuacucaaaucaaucuccccgagaauucagggaucggagucuuuaaggagaaaugugguggauagggagccagugagugaucugggagugcugauugucucacguguccaugugaagagaccaccaaacaggguuugugugaacaacaaggcuguuuauuucaccugggugcaggugggcugagucugaaaaaggagucagcaaagggugaugggauugucauuaguucuuagagguuuuggcauaggcgguagaguuaggagcaauguuuuuggggcagcggguggaucucacaaaguacauucucaaggguggggagaauuacaaagaaccuucuuaaaggugguggagauuacaaaguacguugaucaguuagguagggacagaagcaaaucacaaugggggaaugucaucaguuaaggcuauuuucacuucuuuuguggaucuucaguugcuucaggccaucuggaugcauacgagcaggucacuggggauaugauggcuuagccugggcucagaggccugacacugauuuguuggcuugaagaugaaaucacagggaaucaaaggugcccuccugugcugacucaguuccugggugggggccaaaggacugguuggcaggucugcauggggccaccguguugucagaaaugcaaaaaucuggcuggugcaauggcuuaccccuguaaucccaguacuuugggaggcugagguugucaggccucugagcccaagcugagccgucauaaccccugugaccugcacauauacauccagauggccugaagcaacugaagaacuacaaaagaagugaaauagccaguucuugccuuaacugaugacauuccaucagugugauuuguuccugccccacccuaacugaucaguugaccuugugacauuccucuuccugaggcagugagucucaggagcucccccaccgagcaccuugugacccccgccccugccugcaagacaaaacccccuuuaacuguaauuuuccacuacccacccaaauccuguaaaacugcccuacaccuauuucccuuugcugaccccuuuuucaaacuccgucugccugcacucaggugauuaaaaagcuuuauugcucacacaaagccuguuugguggucucuucacauggacacguguaacagaggugggcagaucacuugaggucaggaguucaagaccagccuggccaacguggugaaacccugcaucuacuaaaaauacaaaaauuagcugggcauggugcugugcaccuguaaucccagcuacucaggagguugaggcacgaggaucacuuaaacccaggaggaggagauugcagugagccaauugcgccacugcacuccagccugcaaugcagagugaaacugucuuaaaacaaacaaacaaacaaaaagcaaaaaucugaaaagacaucucaaaagccaaucuuagguucuacaacagugauguuaucugcaugaauaauugagaaaguugcaaaucuugugaccugaggaauaacggcugguaauuauuuaaaacucaagccccucucauccuaacgugguggccuuucauucauuuuacaggaacaguuuaguuuugggggaaagcuguuauuuaaacuauaaacgaaauuucucccaaaguuagcuuggcccaugcccaggaaugaccaaagacagcuaaccaguuaccggaaacgggucccaaucuagaccccaagagagaguuguuggaucuugggcaagaaagaauuuggggugagucuauaaaauuaaaguaacuuuauaaagaaaguaaaagaauaaaagaauggcuacuccauaggcagagcagcaacuuuggcuguuggacuaaggauauuuauaguuaauuauugauuagcuauaauauauuuuaauauaauauauauaauuauaauacaauauuauauauaauauauauuuuauguaacuauaaacaagggguagauuacucaugaguuuucacggaaagggguaggcaguucccggaagugaggguucuuccccuuuuuagaccauauaggguaacuucuugauguugccauggcauguguacacugucauggugcuggugggagugucucuuagcgugcuaauggauucauauuaggguauaaugaguaguaaggaugaccaaaugucguugccaucuuuguuuugguggguuuuggccggcuucuuuacugcaaccuauuuuaucagcaaggucuuuaugaccuguaucuugugcugaccuccuauguuauccuguaacuuagaaugccugaccucgugggaaugcagcccaguaggucucaaucuuauuuuacccagccccuauucaaaauggagucacucugguuugaaugcuucugacaaaccucugagacuaaggacaagauggagucuguuagguuaguuuuaauuuccucaguuauuauuucacaaaggggguuucagaaagauagaaaaugcuagaaagagacgggguagucagugguagggaucuugagggguuaaaaaagggaaggagcuggucccuuugcaguaggaagugccaccucacuccacucuugccagaaagccuggcucugucauaaggaaucuuggcccauugucacucucauugaugacaacccccgcccccaccacuaccaccuuaacuacugaggggauguccucuggcccagaaggaaugcauuggcucuaguugaagggguugcugguuuguaaauagcauccccacagucagcagacacagagaaugccauggggccacucaucagaaagguggaggggcuuuaucuguggguagaugagagccauguagaaccugcaugcugccuuccauuggaaucucaggcucuaaacaaggaggacaaccuuuucugcccuuaaucaccucucacagaugagaauccacccaagaagaagaaaaaaaaucagccccuuaaaaugcugacuaguaacaucaguuuuuggaaggauacuauuuuuguuuccauucugucuuuauaguuugaacuuuuccuuuucauagucuguaaauauucaucaucucagagccuuuugaauugcaauggcuuuuagucaaaacugagcgcaaugugccauuugaauaauaagaaccucauuaaagugaggcaaaaguaauucuuuuccuuuuguacaagccaauuaagugucuuuacaauuaaaacaaagucaagcacuuuauaguuucauauuccacaagccuguuuuuaauuaauagaggugacaaguuuuagguacaggauacauauuuugccucuggaguugugcaauuaacauuaaugaaggguauuaaaauuuggugagagaggaaaggguuuucccagguccucuguggguucuugccuccaggccugucuuugguagcaaguuccuugguuugcugagguuugcauuuucuugagagaauguacaggcaagaauaaaaguaacuagaagagacauuguuguuauugagaaguaugaaguuaaaauucccaauguccaggccugucuuaaaauuagguaaacacugcagaaacuaucuuugaggaauuuaauuuugucuuguggauaaaagugaaggauaaagaggagaaauaacaauuaucuaagcuggcaggccagcaagauacuggggcuuuacuucucacaaccaugggaggaguauauuuaguuuacaggggaggacacagauucacaggggugaacuaacuggccaugagucagguaaggaaaauaacauggcugagcuacaguuucucuaagaaguugguucuguccauuucagggagcuuauguaagacagaagguauugugcaguagccuugaagucaggugacccuuuggggguguguguguguuugcuucuuuauauuagcuuuuuuuucauuuugagacaggguguugcucuuccucaguugcccaggcuggagaucaguggggugauuacagcucacugcagccacaaccucccagguucaagagauccucccaccucagcuucccaaguagcugagacuacaggugcaugccacuggcuauuuuuauuuuuuucuuuuuaguuuugaguuuuuaauuuuuuguagagaugaggucuugcuauguuguccagguuggucuugaaccccugaguccaaaagaugcugcugucuuggccucccacugugcugagauuacaggcaugagccaccauaucuggccuauguuagcuauuucugaaacuucauuucugucuguaaauggcaaucauaauauaugucacguaggguucuuaaauacaaaaagcucuuaaaaagugccuaacccauaguuaguacucaaaaaaggaaaaaaaaguauuaauagcccuggaaaagugagcaaaauauuucagaugcaaccugaaaggaguucaaauguaagucucucuucacuuugcccaucuuucccucuuccccgcaagguuuuuagcagugguccugucuuacuacaauauaugaauuaucccugcuacaaauuaguagauucugcuuugauuugaagcagagucuaaugaguguuacagguaggcucggugcuucaaaggauuucugccuaucucuucacagaguagcugggcuauugagggacuguguauugacaauuguagugggcacccuauguggaaaacagguguugucaaauaacugcaacugaccccaaccacaccaugacuuuucagguuuuagguaggggaugggugggaaaacagaugaggcaacagaaugaauuauuccuuaauaagauccagauuaccgagugauaauaagauuugcaugaauacuucaaacaacaacagugauuaaauacguuuuucuaguuaaaaaauuaaugagugcuuuccagcaagcgcuuaaagaauuaauacuggccgggaacgguggcucacgccuguaaucccaacacuuugggaggcugagguggguggaucacgaggucaggaggucaagaccauccuggcuaacauggugaaaccccgucucuacuaaaaauacaaaaacaagauuaguggggcgugguggcgggcaccuguaggcccagcuacuugggaggcugaggcaggagaauggcgugaacccgggagguggagcuugcagugagccgagauugcaccacugcacuccagccugggcaggagacagaguaagacuccaucucagaaaaaaaaaaaaagaauuaauaucaauuuuccacaaacucuuuuaaaaaaacagaagaggaggaaacacuuuccaucugacacugugaagccacuauuacucugacaacagaggcagacaaagauaucacaagaaaaggaaacuuuaggucacuuucacuuauaaauagagaugcaacaauuuuguacaaaaugcuagcaagccaaaugcagccacauauacaaagaauuguauauuaugacuaaguggaauuuauccaaacaauucacgguugguuuuauauuaaaaaaucagucaauauaauauaacauaauaguagaauaaaagauccucucaauacauacauaaaaacauguuuuaaaaagguccagcacgcuuucuugaugaaaacuuuuaguaaacuuggaacaaaguggcauuuucucaacucaauaaagggcaucugcaaaaaacccacaaaugacaucauaauuaaugcugaaagauugaguaccguccccuuaggaucaagaaauaagacaaggauauucacucucaucacuuuaauauucuacuagaaauccuagcuagggaaauugggcaaaaaacaaaaaagcaaaagaauggaaaaaaaagauccagauugaaaagaaguaaaacuaucuuuauuugcaaaugaaaucaccuuaucuguagaaaauccuagaaagguacuuaaaaaauauuaaaaugaacagguucagccaggauaaaaguaggauaaaaguuuaauaugcguaagucaauuguauuucuauauacuagcaaugaaggcaucccauguucauguaucagaagauuuaauauuguauagcugaccaaacucugcaaauuguguacaaauuuagugcaaucucuauuaaaauuucaguugacuuuuuuacagaaauugaaaagcugauccuacauuuuguauaugaaugcaaaggaaccugaauaaccaaaacaagcuugaaaaagaagaguguuggagggcuuccauuucucaauuucaaaacuuucuauaaauccuuaguaauaaagacagugucauauuggcauaagaauagaucuauagauaauaaaauagacuugagaguccagaaaugaauccaugcauauugugaauugauuuucagcaaggaugccaagacaauucaaaauagucuuuucaacagugaugcuagaaccacuggauagccccaugcaaaagaaugagauuagaucacacuugcauaaacuacacagcaaaaaauagcaaaaaaaaaaaaaaaaaaaaaaaaagggucagagacuuaaauguaagagcuaaaacuauacaacucuuagaagcaaacauagggguauauuuuucugauuuuggcuuagacaaugauuucuuggauacaacccugacagcacaagugacaaaagaaaaaaagauauccagaaugauccagaaugaaaaguguuugugcugcaaaugauaccaucacgaaaguguacagaugaccuacagaaugggggaaauacuuacaaauuaaauauuaaauaagggauuuguaucuagaauaaagaacuuuuacaauucaauaaugaaaacucauuuaaaaaaugagcauaagaucuaaauagauauuccuccaaauaugauacacaaauugccaaugaauacauaaaagauguucaaucucauuagggaaaugcaaaugaaagccacaaugagauuccacuuauugcuaggauggcuaaaauaaaaaagucagauaacaaauacuuacaaacacauggagagaugaaaguucaaauacaguccuggcggaaauguaaaauuguauggccaaacuggaaaacaguuuggccauuauucaaaaaguuaaacauugaauuaccauaugacccaauaaucccacuccuagauguaucuugaagagaaaugaaaacaugcauuuccauagcaucuuacaaaugaauguacauaguagugauauuccuaauagccaauaaauggaaacaauccaaauauccaucauuggugaauggauaaacaaagcgugguauauucauauaauggaauauuauuugcccauuaaaaagaaauggauuacugauauaugcuacaacauggaugaacccugcaaacaucaugccaagggacagaagccagucacaaaagacuacguauuguaugguuccauuuaguauauaaaauguccggaauaggcgaaucuauaggacagaaaguacacugaugguguuuugggaauaagaguguagguagauagaggguggcuagugauugcuaauuuuuuuuuuuuuuuuugaguuaaaaaagugcuauaaaauuagaauguaguuaugguuguacaauuauuugaguauacuaaaacagcuguacaguauacauagguagauuuuaugguaugugcauuauauuucaguaaaguucuuuaauaaauuagcuaaugcuuauuguagaaaaguuggaaaauaccaaaaaccauaaacaggaaauaggaaaaaaaguaauccugacuguauaucuggaaaucuuuucgugggguaugggguaugaaucacacauauuaauuuuaauuuccugcuuuuucaauuaaauugagaaaguuugggaaccucuggcuuaaucauuauuuauccacuucucuguuguuggauguuagauugcuucuaguucauauguaauuuuauaauuuuaguugacaugucauuauggauucuugggcauaaacguuuauaugaauuuugaauauuaggaaauaaucuuggaagcuauauuaguuuucuaaagcuauuauaacaaauuaccacagauggagugccucaaaacaacagaauuuuacucucuuacaguuucagagaccaaacaucugaaaucaagugguuugcagcguuggcuccuucuggaggcuggaaggagcaucuguuccaugccuuucuccuagcuucccaugacugccagccacccuuggaauuucuuggcuuuuaucuuagucagucuaaucucugccucugucuuuccaucuccuucucuguggguguuccuucuccccuucuguuuuguaaggauaggccugucauuggauuuaaggcccaccuuaauccaagaugaucucauuuuaagaugugggacuuaaucacauuugcgaagacccuuuuuccaaauaaggucgcauucacagaucccuaccauucaacucacuauggaagcaaugggaugggagguaccauucaacucacagauuccuaccauucaacccacuauaaagcaguggcauaugaaaaggaugggagguugcuaugggaauggucugccccagaugcagguaaaauggggaagcauuuuauauagaauggaaaaacaacaguaaagcuggcuaaaacuugaucugcuuuuuacagucaugugcugacaauucuaaacauuaucaaugauaaaauacuucucccucaugauauuaacugugcaauuuuugcugccccugcuacauacaugcuuuauugcuuggaaacaggauuacuuggugaaauaaugugaaucuuucaauucucaugauacauguuuucaacuuaauauccagggugcaggaauauauauucccaccaacuuuauacaagauaauacaaauauaauaguaugaauaaauaugcuaauuugauagaaaauauuuuaauauuuacuacuaguguaguuggacguguuaaauauugcaaugguuauuuguaaucuaccuuuauaaaauuucuaaugucugccacuguuucuguuagacucuuaagaagauacguguuugucucauagauuuguaagaacucuuuauauacuaaaaauauggggcuucuauaugauugcauauauucgucacuuuuguuccacuguuuuagagagcagaagauuuuaauuucuauaaagauuuuuauguuucccuuuauugcaugccaauguuuguuuuuuaaaaacuuguacgucuuaggcugcgaugugaaaagugucuuuuuuuugauuuggaaacagagucuugcucugaugccuguagugguaugaucauagcucauugcagcccuugaacuccugggcucaaguaauccuccuaucucagccuccgaaguagcugggacuacagccacacaccaccacaccuggcucacuuucgggugguuguuguugagauggggucuugcuguguugcucaggcugguuuugaauacugggcucaagugauuauccugccuuagccucccaaagugcuggaauuucagaggugagccacugugcccagccuccuguuuuuuuuacauguauauauauauauauauauauacacacacacacacacauauauauauacacacacacauauauauauacacacacauauauauacacauauauacacauauauauacacacauauauauauacacacacacauauauauacacacacauauauauacacacacauauauauauauacauauacacacacacacacacacacacacacacacacacacacacauauauuuuuuuuuucuuuuagauggagugucucucuguugcccaggcuggggugcagugacaugaucucugcucacuacaaccucugccuccuggguucaagugauucuccugccuuagccucccaaguagcugggauuacaggcgugugccaccacgcugggcuaacuuuuguauuuuuaguagagauggggguuucaccauguuggucaggcuggucuugaacuucugaccucgugauuugccugccucagccucccaaagugcugagauuacaggcgugagccgccaugccugcccuuauuuuuauauaucuuccauaaccuuucuaucucuuucuuucucuuucucuguuucugugugugucugugucugauaauaaaauacauuaaauuuuauuuuauaacauaaauguuuuauaaggucgguagauuuguuuaugauuuuaauggcugcauaguauucuaucauauggauauauucuaaauguaauaauuccucaaugguauauuuaguuuacuuuauauuugcugcuuuaguuugucacaaacaccguggauagccuuguauauauuuauuuuguuguauaguucuuauugguacaguaugauuuuucacaaguauacaauuacuuucugagaauuuagcuuuuugauucacgugaaagccuuacuuguauuguuaacaauuuuguuacguuugugaggccuaggcagaaggauugcuugagaccaggaacucaagaccaccuugaccaccuugggcaacauagggggagcccaucucuacaaaaauaaaaaauaagaaauaaaauagccaugcaugguggugugccccuguagucccaguuacucgggaggcuaagguggaaggaucgucugagccugggaguuugagacugcagugaguuaugaccacaccacugcacuccagccuggaugacagagaaagaucuugucaaaaaaaaaaaaaaaauuaaauauauacaaaauaagggagaauacuaugacaggcuuccacuuaccuaucuuuaggcuucuuuauaaaauguucauuuaaucugaucucuauaagaaauucuguauccuuaaacaacaugugcccuucucuuuacacagagcgauuacccccuugcuauguuuuauuaacagcuagcaagugcuggguccugugucaguuguuuuguuuuuucuuuuucuuuguuuuucuuuucuuuucuuuucuuuuuuuuuuuuguuuuuuuuuuuuuuggagauagagucuugcucuguuggucaggcuggagugcaguggcaugaucuuagcucacugcaaccucugccuccuggguucaagugauucuccggccucagccuccugaguaacugggauuacagacauauaccaccacaccuggcuaauuuuuuuuguguuuugacagagaugggguuucaccauguuggucaggcuggucucaaacuccugaccuaaaaugguccaccugccuuggccucccaaagugcugggauuacaggcgugagcccccgcgccuggcccugugucagccuuuuuaacagcauaauuuuuccuuuauuagucauaacuacuuuaagggcuauuuugauuuacagacaaagugagacuuggaugaauuaagaaagaauuaaucaggugguugaaccugaguuccaacuagggugacaacucuucgcagauugccugcugcuguccugguuuucacacugaaaguuccguauccuaauaagccucucauccucagcaacggaggacaguugcccacucaaagccuugugacauucuaggguauccuauuucuacauggugggaaucuagaagacggagaaagaauuucucauucccgaaggagcauggauuauccuugguuguaguguuuauguccacaucacguggauucccgaaggagcauggauuauccuugguuguaguguuuauguccacaucacaugggauauuuuauuuuucaggccucuucaugugcuugugugcaacgcagcaacuuuugcucuacccuggagucucaccaaagauggccuggagaccaccuuucaagugaaucaucuggggcacuucuaccuuguccagcuccuccaggauguuuugugccgcucagcuccugcccgugucauuguggucuccucagagucccaucgguggguuugaauugcauauuuguucacuuauccccuuucucauaccagcuaauauucccccaaggcucucauucugaaaauaauuuucauuaguccugcuugagacauguggguggacucagcuuggcucacuuaauuuuuccaggucuuuuuuguucgccugugauugugggggacuguuuagaaggacuuucuagagcaaggaagauuguuuuuacgacuauacuucaagcuccucauugauuuugcuuagagauggaauaauaauugaugaaaucugaauggcaugaccuuuauugauuuguaauucaacaacuucaacaucuuaccaagaagaaugugcaguuauucuagcaggagaaacaaugcaauuagagccugcgagaugaaaucaaauuguuuuauaaugagaaauuagggaauucgaggcagacauuagcuguguaauuguggaaagggaagaacuguaguuagagcauauuagaaaucuggccgugccucuuuugguuaaaauuucaauuaaaacaucagauggcacuuuuuuccuauugccauuaggagaauauucaauugacugaaaaggacauuugaaaauuuccucguauuuucagcauauuuguuucuagaguuggagaaacaacuauuugucuagagagaaguacucugaaaagacaaaggccuugcugggugaggcuggauuuaauacauguuagggagauuucucuuucacguuugcuugguguguguuuggcggggggaacuuacacucuuagcaaaguagcuagaaaaaaaaauaacgugcaaggggccuauuuuuuccuccuucuucuccgucuuaaguccugaaauguuuuagugacccagaaugaagcuuauuuuuuuaaucauacuuccauaaaauguaaccccugggacuuggaagagagagaccagccaaggguuagcuugaacccuuuaucacucccaaacacaggggcuuaugguauaagugacacacugcagauagauuuacuuuugccauuuuaaauuuaugauggcugaaaugaaagguaaaugccaguaauaauccucccccguguuaaaagacaugaaacaucuaguaauuaggugguaacaaaaucuggacagccuuaucuuugcaaaucacaccagguuugugaaggaaaguggaguggcccuguuaaggggcgagggaggcuacugugggggcaggcagcagagagagcuccagaaauaaaucugccagccccagucauccaccagauguggagggcaccacgggauauguuuaaaugagcugguauuuaaugggagauuaugucgaauugucagcugcucacucuccuuguaaaucuguaucucaaaugguauuucgugugacgucuuuguucuuugcuuaacuacgguguaauucaugccuacuucagagauccaaaucucagcaucauuuaaaagauuaguuugaaaggaagggacuugggcucuugaauuagaccuauguuaguuuauagggaggccuuccugaaauguguugucaggcuugcuccugugugauggcuggcacugguuuuaugcuuuccaauuauucuuugcacaucguuauuuauuauuacuguuauuauuauuugacauggagucuugaucuguuaccaggcugcagugcaguggcaugaucucggcucaccacaacuucagacucccaggguuaagcgauucuccugccucagccuuccaaguagcugggaccacaggcgcuugccaccacaccuggcuaauuuuuguauuuuuaguagagacgggguuucaccauguuggccaggauggucucgaucucuugaccuugugauccgccugccuuggcuucucacagugcugugauuacaggcgugagccaccacgcccggccucuuugcacauuauuuaaggguguuuuaacaaaauggcaauuuccccaggcuggcuuguguauuaccuucgcauugcaucccuuggcucccaugagugagcguggugacuuggugcguaggugguacgugaagacaguugcucacuacccaagaacucagggcccuaaaccaugcuguaaaaugcaagugcugauaucuaauuaccuccaucaaccuuggcagaaucucuucguuggaguuaagacccccuguuaggggaaaaaagaaaguccuauguuugcagaaaauauuauacuagacugcuccaaggcaaaauauuuauuagccuuccugugucuucacuguguuuuaguuacuuaucuggaaucugagcaacugaauugaguuucugcauaccuaaaauacaucauagugaaaugagaaguugacuucuuugcugugaaaaaauuucagauaacaauuaaaguagaaugaaaagagcagagugcugguugaacaacccucaauggcugcagcugcauggagugccaaauugcccucccccaccccacacacaaaaucacacauacacgcacgcacgcacacacacacacacggaguuucucagcuucuguguagacagaauccagccuaauuauuuuaggcgggaauuuuaaaaauccucaauaaaauugggcuugguagcacaugccuguaauccuaucuaguaagaggcugaggugggaggauggcuugagcccaggaguuugagguugcgguaagcguugaucaugccacugcauuccagccugggugacagagugagaccccaucucuaaaauaaaaauuaaaaauuguuuaaaaaaaaugcaguauaggccaggcacagugucucacgccuguaaucccagcacucaagaguucgagaucagccuagccagcauggcgaaaccccaucucuacuaaaaauacaaaaauuagccaggugugguggugcacgccuguaaucccagcuauuugggaggcugaggcaggagaauugcuugaacuugggagguggagauugcagugaguggagauugcaccagugcacuccagccugggugacagagcaagacccuguuucagaaaacaaaaacccaaaaagcaaaacccccacaguauauauagaaauacaagauuugugaggggcgggggucccccuacaaagcaaguguuacuguccacagagcaaaugucaauauuuuaauguacuaguaagggaaaauucuauuaagacauaauuguuuggcuuugucaguuugucaacuugaaaauagagucagcagcaucuaaagaguuguuuuacuaccucuggagcugagaggugaacauagucguuuuucaggaagccguuucuggcucagacagauaagaagcuggcccacccuugccacuuccuggaggacugucagugcuagcuaaugagacuguaaaaguggacuaucugcccaggagacagugaggaaggaaaucaggggucacccuuacagggaagggcucuuugcagagagagugccugauacguagcagcugguacuucuccaucuugaaacuguccuuccugguuuugucuaauuugucaucaugggauucuuuugacuuguuucuagauuagggaucaagaagaaaugacuuucuccucuuagacauuuaauucacuuaguguucccuagucaugacauacuucuguguuauccuuaaauacugaaacagggaccuuauucuuaacaguagaaaaucacuguguaugaugauaguguauaccuguaauaccagcuacucaggaagcugaggcaggaggaucccuugagcucaggaguugagauuagcaugggcaacaaagcaagaccuugucucuaaaagaauaagcagaaaccaaaagcccuaaacaugaggaaauuccacauguaaacauuaauggaaaacauagaagaguugaaccuagugguaaauuuuaccuuuagagcaaugcuugaaacaagggaaacugucaaauucucaucaugggauuuguguuccuuuguuuuuuuuauuaaggacuugguccuuggauuggaauuccaaacccaugaccaaacuguaaucaucuaauucuguauugaguccuuacuaugugucaggcacuguaguaagcaacacucaagaaucuuacagucuacuuuccaagaauucacagucuaguuuuggaaucaggugaucaauugacuuacagucugguauggugaugacagaggagcaauguacagauagaacagaaggauggcacagugagccuuuucaccaaucuuggaaggccaguaaugucagugaacacuaggaauggugucauggccuggguccugaagaguggauacuuaauguccauggaggcaugcauuuuuaucugccuugcauggcuucuuucauucucucccugacuuccacccaaaaaaucaccaugauauccagcuguggaagaguucauuauggagagcuuccuggaagaaguagucccugaacuggguugggcuaaacaaauaugccaagaaggguuucuggaagcaguugacaaaagaugaguagagagagggaggggguggugcuauauuuauuccauaccuuucagauacucucuaaauccuugucccuguugucuaugccauguagguagaguuuucaagucaugucccauaccuuggaucauuggauucucaacucaguagcaccuuugugugacaccucuucuguaauaccuuauuauguugaaauaaaguuagcaaauaacauaacuuacaugcacaaauauauuuucaauucgauaugauagcuuuacuguaaugaaagaaaaaauaacugaaacaaaauggcguguguuucaacauguaaaugcuugggccaggcuacaggaaagauggggauguauguauccguggaugaaucaccuugaauggacucucauaaaaaagcccaccauuaccaggugugugguauugcagacuccagcaccaccaaccuugagugaagccugacuauauuagucuguucucaugcugcuaagaaagacauacccgagaccggguaauuuauaaaggaaacagguuuaaugggcucacaguuacacauggcuggggaggccucacaaucauggcggaagaugaaggaagggcaaagggaugucuuacaugacaucaggcaacagaguaugugcaggggaauucucauuuauaaaaccaucagauuucgugagacuuauucacuaccaugagaacaguaugggagaaagcacccccaugauucacuuaucuccaccuggcucugcccuugacacauggggguuauuacaauucagugugagauuuggguggggacacagccgaaccguaucagucacccuccaaaaaucacacaaaaucugaaagugcuuuuauucauucuacauguaaauaguuguugcacuacccaccuggaaauucaguggauguuucuaggcucagauaauuauccacaggcuuuucaucuccaugaguguccacuggggcauucuucauugagcaauacaucaugugcauugcaagacaucugccaucccugcuaccaucaccagcagucaucacgacaaccagaagaaggccgucauauauuuucaaauugccugcugaguuccauugccuuagacaauuaagcuuggaagucagacucuuccugugguuuggguacuagaaaaaaggcagccaacaauucguuucaaggucucauuucuguauccuugaugacguuucuggccaucagcuuuguugaugacuuuagagcagcuaugucauuuaacacuagaaauuggaugucaccgaguccuguggaagggauauuuaauuuccauuaaaacaugaauuucauucugcccuugccaugcuuuucuuggucuuagcccaaccugagcugcugauauuaaggaauaauaggauaauuccauaauuuucauuuuaccuuuugcuuuuuguuuuccauagcaguuaucuagaggauucccauuaugcuucuucauuacccggugcccagaaugaacuuauagaagcagaauaugagggguccuuugacaaacaugagacuguuuagaaaauuccuuuuguuugcugugauccauuuuguaagggaagucacuauaauguuguuauuuaagagaaagagacaaacggaaagaaacaaacagcugguguuuaacgacuccgucagacccaauuauaaagcaucaacuaguuacguugauuuguguacauccaugccauggguauacuuaaaaacauuagauuuugccagaacucaucuuggcuuuguuuacauuuuucuuuuaaacguauaagacuauugaugguaccucaccaagguuauaaccccuuuauaaucauuaauuuuuaaucuagaaaagagucuuggagacaacaagacucaucuauaauuucuuggaugcucaaaugaaaauauacaggacucaagcauuagcuaaaauaauccaggaaagcccugucaaagguuaggaaugugauaucuuucuguuuccaaaagcagcagcccuuuauucaagacacuuuucuguuuaauuuaauuaucuuugaacuuccuguugaagguuuugaaaaauauauguuagaggguggggagagaguucaguaugucaggacugcuacauuuaugagugugggucuuuauugaagucucucuuuguagccaauccuuuuuuuuuuuuuaauuuuuaaauuuuaaauucuuacuuuuagauaugggggucucacucuguugcccaggcuagaguucaguggcacaaucauagcucacugcaacguugaccucccaggcugaagcgauccuccugccucagccccccaaguagcugggaccacaggcaugugccaaaauacucaacuaauuguuuauuuuuuguagacauggugucucccuauguugccuaagcuggucuugaacuccuacacucaagcaauccucccgccucagcuuccuaaagugcugggauuagaggcaugagccaccagacaugaccuguguuuauauuguuaaaucaccauugucaaucuugaaaggagacuuuguuuugauguauguaagauugaguuuuuacucaucucuacauaguuuccucagauugcuuuuuuuuuuuuuugagaccgagucuagcucugucacccaggcuggagugcaguggcacaaucuuugcucacugcaaccucugccucccauguuucagugauucucuugcuucagauucccguguacaggcaugccaccacaccuggcuaauuuuuguauuuuuaguagagauggcauuuugccauguuggccaggcuggucuugaacucccgaccucaggugauccacucgucuaagacucccaaagugcucggauuacagaugugagccacugcacccagcauuccuuagauuuccaauaaaaauaaaaagcugugugggaagucagaacuugguugcuucaugucauauuuccuauuuuuaagauuuacagauauuaacgacuccuugggaaaacuggacuucagucgccucucuccaacaaaaaacgacuauugggcgaugcuggcuuauaacagguccaagcucugcaacauccucuucuccaacgagcugcaccgucgccucuccccacgcggggucacgucgaacgcagugcauccuggaaauaugauguacuccaacauucaucgcagcugguggguguacacacugcuguuuaccuuggcgaggccuuucaccaaguccaugguaagagaacagcuucuggcgccgcaaacaccuuggguccuagagaaaccugcacacuugugucuccaccuuuuuaccucuugcgggcaugagucuggucucaguaauaacauuguccagcccaucauaaagggcucuugaacacauuuucaucaacuuuagguuaagucuguuuggguaaaugcgucuuggagggcuggguagaagauguggguuucaguaucauguuaaguauggcugaaaguccuuauggaaauggugauuuuuuuguuuguuugguuuuguuuuuuuugggguuuuuuauucagaaacuuugaaaaucuauuuuguugaauggagcacuugaaaacugcuguuuugugucaguagguaaacaacaaacauuggugacuacugaauuuucagcagaugugauuccuuuguuucacagaaaaacuguaucuuuuguucuaaauuuuuuucuucuaauggguauaauccucuguuggagaguccuuugauagcuaggaguguguuuucuucuuuacuuucccaaagacaauuuuggaugaaucaugguacugugguuacauuuggaaguguuuacaaaggugauaagauguuuuuauaguuugguguucauuuaucgaccauauuaagaaccuucuucuaugaaaugguuuuaguaggaaguauuuugaaugaagaaagcguauuuuccacaauauauuugguagauuauuuuucaaaaccaaaggacuucaaaaaugucuuccuauuaguggacaccaguauuccaguuacccaaacuuaaaaucuacuugacagaaaucacccuuuucccaaacacauuugccuuuuagcgauaucacaggccuucacaguuggaccuaggauauuaauaaaacaaagcaaaacaacaacaaaagaagaacuauugcaggccuauuauccuccagcugaucucacgaccuuggaaacugucugcugccuucucuuacacucauucccaccugccacccuuaaccuucguauuuggggaugacuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccaccacuaugcccggcuaauuuuuuguauuuuuaguagagacgggguuucaccguuuuagccgggauggucucaaucuccugaccucgugauccgcccgccucggccucccaaagugcugggauuacaggcgugagccaccgcgcccggccuggggaugacuuuuaaaaccacaucaaaagucuuuugaagugcuuaggaggagguaaguaaguauaucuuuuauucuaaucacccaagugguuuuuaggcagaguaaacagacauauuccaagagucgaauacuuaggaucaguggcagugaagugaaaggaccuacggagaaugguguuccaugccgcagggugggauugaucucuaggaaguaaaugaaugaaacuuaccuguagguggaucacaggguuuugaaaucuccccaucacuuugcucccgaugacugcauaagcgcagccucuucaugaaaguuucuuugaccaugguuaugccucauacuuuguuguguccuucaguuuacaugaaaagaaggaauauggaucugaacugggugccagugccauuuaaaugaggcauuuaggaauggggagaggagagagguggauucuuccuuauuuucugcuggcccagugccuuccgcuuuaacaagcccagucaaccaucauuuguaaucuuugggucuugagucaucucacuuguauuugaucauugauguguuuuaaggagcucgguucaguggcaucagagaguucguuuucuccuucuuccauaaggucccuaaucagaggaacgggaugggaaagcuuuagagaugagucugugacuauggaauuuggugaggggugauauaaccauccugccauuuguuguagacucgaauggaugaggagucauugauagaaaauaguggaaacuguuauucuguggccugaucccauugcuuagggacucugugccagggcaugugggaaaagaaggaaggcaaguucugcuaaaauauaaagucaggguaaacauuuuuauuuauuggagaagaguugauuauuaucuaauauuuaauauaauaugcuuaauaaagucagacuugaaaguuggcugguuggaccuaacgggaguaucucuaaaaaauaccagcaaauuaaguuggaucggugacuguaucaugauaucggaguguuagcuguuuugggaguacgugugcucaggacuugggcugaguggaaaaccagaguaugggguuagaaauggaggcagagggacuaccaugucggggaggaugcacaaugaauuggacgaagguugcaacucagugagcaccguaccuguagugugucuuaguaauagcagaugcccaaccuccaugccuaacuccuuugccuaccccaccagugugcagcagccucugccgcacccuacugcagucucuccuauuucccuggcaggagagcucagagacuacuugugaacaggccucaaugccuauagcaaggcaaggcuugggagaaacaaauguccucugggagcagccuuggguaaaagauuaacugcgcacugagcuuuagaucccugagugagaaagcugugggaaaaugaguguguagcucaugagaggguuuggagaaaaguggugacaucgcaaaaaucccagguuuuguugaaguugucuguggaggggcacucauagaaagggcacuggacgugagcauuucccuuguaguugagaugggauuugacaugacuuccuggugguggcaagacaagaaaguggcaaccugggacaguggaccucacagcucuccugcuaauggugcugauggcuaagcucagcucuuacccuugaccacuggaacaacuuagacaugucaccagcuuucugagccugucucauuacgaugaaaauugugauacagguuaguguaaggaccgacaauaaugcauauaacaucaauaaugauggauauagaauuucugcaguuauuauaaucuggcucuccaguaugguagucgugggccacauguggcuauugaguucuaaaaauguggcuaauagaacugaggaagugaauuuucaauuugauuccauguuuguuaauucgaacugaaaaacaccacgugugccaaguggcugccauacuggagagcguggucaaaugacaugccuagcucagugccuuucgcaugggagguaugcaguacuuccugccacgauggcuguuacucuugucguugugagcagugccuuggucccgaugaugauucuccaaaauguaaucucugcugacagaacaagagucugcaaauugggagucuggaaagggaagagaagggcuuugucccuggccccaaagacucagggagagguuuacuggccagguagaaagggcguccaggugaagggacccugguucagugaucuccaaccugcacgucucauuugugaggaagccguaggguguggacuuuucuuguuucugaccuugagugauuagaaaauagcagcuuuuauaugucacaaauggacuuuagauaagcaugaagaugacgaagacuguggaauauguagcuaagagucuuacuaaaauccucucuaguguauuuauauauuuaagcguuugguaguacuuuuuuagccaucagcguucucuauauuagguugauacagaaguuauugagguuuuugccauugaaaguaauacgucacuucaugcagagguggaauuggcgcucugagcuugcuugucaaauucacaggcauucacuuuucuuucauaaacauuuaggacucuguauuuaggagaggaaucacugugaauguagaccucggguuggucauuuuccuaguaagauagaccagacugacuggaaaagucacccucuugggcuauccugcguauguggcucggcauugcuuccgucaggauaaugcaucaguuucuuggacaaagggugcauuucugcuauuugaaugcagacauauuuuuggauauaagccacgcaguugcaucccauuucuuccguagguaaaggcuggguuucuaauugugauugagaagcuuagcauagaugcaaugucccuaucaccagauggcuagugugcucugccuugucugccuuuuaccuuagagagggugcuuccuucugacacggguauugcuggaguacacauucuguugcaugaggucaggggagcaagaaauacaacccagacuugcgcucggaagcccugccuucauuucuucucuguagcuggcucccuuaaguauuaaacagcaguauucuaauaucaacgucccuuuuuuauuugcugugacuugcugugacuacggugauuuuaguuacaguaauuaggucacucuucauggagucgggcuauuuuaagugccucuuuaaggaauauuguugcagaucaguaauuuuacaauuggauguucuugugcaacuuuauuaaaugugaucugucuuuuaaauguugcccuuuuacaguuacacauuucuaauuguugcuguaaaugcauuaucacuuugaaauuaauuaauuuuuccauuuuggcugccugcaauauaauaaucacuaaugagaaacucacaggaaucaauucucagcacagcggccccuacugguaaagccaugucucugccucccucuucuucuucagauccagagaacuggacaaguguauuggggcguccugggagggaaguguuuguuucuuccucccuucaauuuauggugaaauaaaaaucacagauaaacuuggaaagugaguuauuuuuaagugucguucuaaaaaagaugcaauauacuucaaauagcugcuucuaaaauauguuaaaggaaacuaacauuugcugaguacuuucuaauaaugaagucacaucauacgugcauuacauguuuauuuucuugacucuagagcauucuuuuaugcaguuaaauuacucuaaaauguuuugcaccugcacgcauuaauguguauuguuugguaagaacuuucgaguuggugaaaaaauguauuguauuuuaguaucuauauuuauauauacauauuagucuauggguuuuaauucacaaaaccagguguuguaucuggugcacauaagggauuuucaaggcuaaucuuggguuuuugcaguuguaaccaugugugaugacuuuagaauccuaccacacuuccaaauagagaugcagauugaccauuuucccagauaccacgaugcuuuauguaucagcauauauuuucauuaauuucucauaauuucuguuagaauuaauaauuccaaguucuacaaucuuagaauuauuaucuuuauuuuguaauugaaaagcacagaaaccucaugcagcguguucaagaaaaugauauaccagccuuguaaacuuucacuugcuaauugcagcugcauuugcuuuguccaaugcacgguaaugccccuggcauccauaucuaguuaugcaguuaugcuuccuuuuuaaaauguuugacagcaccuucacugaaaugaaugcugccaccaccgccaaccccaccuuuuuuuuuuccacauaagcuuucauuucugguaaauacauccuugccagaguucccagguccaagccgguccuuuguggaccaguaugcagauuugaaguugagcacugucacuugccucuuaggaguguuuugugcaaccacauauuuguguuggcagauaacaguagaaagaauaucauguguuaggguagcaagagcuuagcagauguuuuagggaacugcauuuucaaaucauuuuacauuaaaaaauggcuuacguuuauggaacuucugcgacgaucggguuacguuuccugugcccguguaaagccagucaucgugcugaguuuuaacggaugugcagcuacccugcuaauggaugggccggcaaugcugguccuguugcaaaguuauaaauuauaacuagaaaaagcacaagaugucauucuucuaaccuucgugaaagccaaacgggguaauucugcccuugaauaacccgcugcagggugauuuauaguuguacaauuuaaaacguaaugaaggagauaauagauguugauuuguuccugaaauuaguauuuuagaaaaauacuucucccccuuuccaucuuuaaauaccugcagcugacuacacuauagauacuaucaagggcaaagcccccuguuugaauguguauugguacauugguguaucacauacaaggcagaggguguauaaaacaggcuuucuguugcgagggggaaauaugguuuucaaaguggaaauuucauuguauucuucaugaaucuaaacauuuugagacuccugagugagguuugaauuuucugguugccuuucucuugccaguccagauauguuagaaaacuggacucucaggaccccucugugguuggaccacacuggcgcuuuccugcaguugucugucaacagaaggaccugguagcuggcuuguccucuuacaccacugaggccaccuucuugcaggaagaaacauacuucuuccugcccuggauuaacauuaccauugguuuuaguagucuuacgucauuauguccaaagcuuuuaaguuuacagugcuugcuuaguccagugaccaauggauguaaguaaguuggaaaagggcaaaggauuuagaaucaugaggguuguauucaaacugcagccucuacucccuuuuaguuacauaauuuugaaaucauuugacauuucugagguuaauuuucuacaucaguuuagcugcuuuaggccgcaaguuauuaacacccacuuaaagguggcugaaauaauagagguuuugcuucccauguauccagaguugcugaggcagcaaggguuguguuuggcuacuauaugaguagcuccuuugugauaaucuuuacuuuucccucaugcuuacaagauggcuucuguggugccagccauugcauccuauuugauaaggucugaaggcacagaugggagggaugaggcuccucauugcaugccuuuuuccuuuaucaagagacagagcauucugcuucagaacuguccuccugaguugacuucccgucagaucccacugguugggacugagucaucuguuuguauccuaguuauaaaggagacuagaaaagugcauaacuggcuuuuugagccucuagaguggcaggcgaacucugauuuugaggaaaaaggauaggguaaugguguugacacaggcacuguugaauacguauguacauauuuuaauaguuuucucauuaaucaaauggaaaugcuaucgauuuuauaggaucguugugagaagaagugagaauugaaaugaaaggcaucuagucuuccccgguccccauccacuugacccaccauaccucaagccacuucuggcuccaugcucuuucuuuccuuaggguuuugaaacauguucuucagccuagaauacuccuccuccacucuuaauuucuacccauccugcaaaacucagucugaacagcacacgucaaggaagcaguuuuggucucucagauuauaugaagcucuccaauauguucuuucagaacagccagugccuagaauacugccugacucguaguagcacuccuuauguguugaaugaguaaaugaagagucccuggaauuucuucuucauaacauugaacacaacugcaguuugaaaacauaauuucuguaguuuuuuuuuuuucuuuuuuuuugagacggagugucucuccguugcccggauuggaguguaguggcacaaucccggcucacugcaaccuccgcgccuccccaguucaagcaauucuccugccucagccucccaaguagcugggauuacaagcacuggccaccaaacccagcuaauuuauauauuuuuaguagaagcgggguuucaacauguuggccaggcuggucucaaacuccugaccucaggugauccaccugccuuggccuuccaaaguguggugggauuccaggcaugagccacugugccuggccuguaguuucuuuuucuuuuuucuuuucuuuucuuuuuuuugagaugaagucuugcucugucaccuaggcuggaaugcaguggugcaaucuuggcucacugcagccuccgccucccagguucaagcgauucuccugugucagccuccugaguagcugagauuacaggugugcaccaccacgcacggcugauguuuguauuuuuaguagagacgggauuucaacauguuggccaagcucgucucaaaccugccucagccucccaaagugcugggauuacagaugugagccacugcacccagccuguaguuucuuauuuaaugucuguccccccuucucuugacagugguguuuuugccuucacacuacuguaucccugguccauaccguaaauguucuguaaauguuuguaaaugaauacaugaaagaugaccaggugcugaaucagugagaguccuuaauguacuucuuaucauuuaucccucugagguaggcaagggauuauaguuuagaauguguaaauacguaaaagauaaggcaaggagaccugcugagagucacacagcaagcccccaaggucccccaggcucauggucaaaugacauguaagggacguauccagcgguguggguauguuuggagggaaugaauguaaggagagagaggugaggcacaggagagacaggaugagcuuuagagguagacagcucucggguccagcccuagcucucucccauucuaacucuugggcaagguucaaaaccugauuaagauucaugcauaaaacugagauguuagaacuaccucaugggcuugucuugagaauuaaagacguuaugaacuuaaggccucuacagugugcuagaugcuuaagaaauguuaacuacuauuguuauuggcuugcaguagaaauuaaagauuaugaauguucagcauucagaauauacuagauacucaauaaccauuauugcugucauuauuaacauuauuuuccccagcuuuacugagguaugagugacaaaaauuucauauaugcgcaugaguguguguguguguguguguguguguguguggcugggcaugguggcucuugccuauaauccuaacaguugaggaggccaagcugggaggaugacuugagccugggaguuggaggcugcagugagcuaugauggugccccugcacuccauccugggugacauagugagacccuaucucuaaaggaaaaaaaaaauuauauguauucguggugugaaaugugauguuuugauauucauaugcauugugaaaugacuaccacaaucaagcuaauuaacacaucggucaacuuacauagcuaucauuuuuuguguguggcaagaacauugaaagucuagucucagcaauuuucaaguauauaauacguuauuauuauuacuaucguuaacuguauucaccaugcuguacaauagaucuccagaauguauucauucugucuaacugaaacuuaggauccuuugaccacuaucuccccauuuaucacccccucccacuuccccacuaccagccccuccugggaacugcccucuacucucugcuucugugaguuugacugcuuuaaauuccacacaaaaagugagaucauagaguauuugucuuucugcgccuggcuuauuuuacgauaaauugauugcuucucuucccauuguuuauagauacccauucucguaaugauggcacugugucugucauagaaggccuaauucucccuguuaacauugaacauaaaaaccucauaugggccaggcacaguggcucauaccugaaaucccagcacuuugggaggcugaggcggaugaaucaccugagguugggaguucgagaccagccuggucaacauugcgaaauucugucucuacuaaaaagauacaaaaaaauuggcuggcuggucaugguggcucaugccuguaaucccagcacuuugggaggccgagccgggcgaaucacgaggucaggagauugagaccauccuagcuaacauggugaaacccugucucuaccaaaaauacaaaaaaauuagccaggcguggugguggggcgcggucgugggugccuguagucccagcuacucaggaggcuaaggcaggagaauggcgugaacccgggagguggagguugcagugagccaagaucgcaccacugcacuccagccugcgugacagagcgagacuccaucucaaaaaaaaaaaaaaaaaaaaaaggcuguguguggugacucgugucuauugucccagcuacuugggaggcugagacaugaaaaucacaugaaccugggagguggagguugcagugagcugacaucgcaucacugcacuccagccugggugacagagugagacugaaaaacaaaaaaacaaaaaaaaacccaaaacuauaugugcaagccucaggaaccacuaagacagauuacacaaugcucaucagaacucagcaggcuuccacagugcagauuuuaagcccuccaguugccuguuuuacuggcaccaagaacacaccuuagcuuggaggaaacauuggccacuuucuuguuaaaaacaaagagagggaaacuagaucugccuuugugaggcuggagcaccucaucaauguauuuuuucugccuugcuuuauaguguuuuaaauccgccucggccuuuguuccugaaugagcacccgagaaggggagaaagugacuaucuggccuuaguauguguaacaaauuauuuaaugaacauuuaaccaagauuugcaauuccccuaguuuuaucuucccgguuuccuuuucuucugugugcccguuggcauuuugguaaugugcugccucuuuauaacucuuuguagcucuuuuauuacuuuucuuuuuucuuuuaaguuuguggugccuucuuugauccuccccucuuucaguuuccuuuucuccaauuucauacuuauuuccagugauuuuuggcugcaacgcaguuuagauauuggaggccagcgugauuaaaccgaggccaagaguuuguauugccccaugacgauguuucuggaauguuucuucugugaacagugauuuuuguauaacucacuggacauguugauuuuucccugugagguguaagguaauguuuuccuagcaaaaacaaagagggcugaaaccuggugcucagaaucguuuggaaacggaacuccucucccucuucuuuuuacaccaagauaaagaaauacuuugcaaaucagcugagcacauguucccagcuccgugccgggcucuguggucauggguuuccuucuuuaugucuuacucaucuaauguaauuuuagaguguguucucuuuagauaauugugugucucugagcaaaucacuuauccucucugguccucaguuuucuuaucuguaaaaugaaucaguuaaccaagaauagccaucccuuggguuaauagaacaguuuaacuugaaaggaaauaaaaaaaggagacuaacaugggcccacagacauuguauuucauaaauuuuggaugaaaacugaaccuaccaucauuuauuaagagaauggauauuuucaugucagaaauuauaggaaggauacaguuaugggaugaggagcaauucuuuuuuuuuuuuuuuugagguggagucucacucugucaccaggcuagagugcaguggggcgaucucggcucacugcaaaccucugccucccggguucaagcaauucuccugccucagacucccgaguagcuaggacuacaggcgcgugccaccacacccggcuaauuuuuuguauucuuaguagagacgagguuucacgguguuagccaggauggucucgaucuccugaccucaugauccacccgccucggccucccaaagugcuggaauuacaggcgugagccaccgcacccggccuaugaggagcaguucuuucaauggaauauauuugacuucagggagaacucacucaaaugcugcuguuacuguuuuucccuuuguuggaagugaugggguuguacuuggaaugacuggccuagaaaacccuacagguaccauuuaagcuccauaguucuucuguguguguuucggaucccagguuccaaaccugcacuaaaacuuguugcugcaucucaccuaaucguguagugagccaggugagcucaucugugaaaugcagaccuuucuggacguaccaccucguggggugaagggaaagaaaugauacagguguacaucaggguauaagcuguccuagagucuggauucuuuuuauccagaagccauucuuucagccugugccuuuuuguaaauaccauaccccaucuauuuccacaaaggauuuggggcauuagcgaguaaagggggaauauguucuagaagaagggcgcucaccucaguaaauugaugggugggccacaaaaaucaugucacaagaucuuguugaugugcaugcauucauucauucaacaaauauuauugagcaucuaacauaagccgggugcuuugcuagggacagaaugcuguacaaggucccuguccucauggggaccguauguugggaagacagaugauaggcauggaaaugaagagacaaaccacuccgacuucagcccaggaaggagcuuuaauuugaguaauuguuuucacuaauucaucuucacagaaagaaauaauaugaucaccuucgguuaguaaacaaaacaaauaggcaaacagguuuacaggcugaggugggcuggaucacuugaggccgggaguuugaaaccagccuagcuaacacggugaaacccuucucuacuaaaaauacaaaaauauuaucugggugugguggagcuuuccuguagucccagcuacucuagaggcugaagcaugagaaucacuugaacccaggagguggagguugccaugagcagagaucgugccacuguacuccagccugggugauggagcaaggcucugucuuggggcggggggcagggcaggggaggggggaaagaagagaaacagcuuuacuuacguuuuugaugagccuagccuuugcugugcuuuggaaaaugggcuguggaauuuggcugaaauagucaaaugcguagcuggcuguauguggacugauaacugggcuuauuuugcuucuuuuagaucuggaaagacuaagcgcaaaauagaaaugcuaaugguauugauguguuuuucuuccuuuggugugauaaaaagguaucaguagggaucauucauaaaacuaguuaguaaacuaucaguuuaauguacaauggugaagaaauacauacaucauacuugagaccauguuccagagaguauuuuguaaccugugacgcucuuuucaagucuuagagaggaaguauggaaagagcaugcgcuuuugacugaggaggucuuggguuuaaaggucgaauuuugccacuuacuuucuccauggccuuggucaacauccugaagucucagguccuugucugccuuugcuuugacacgagauguugccugccucaggcgguuguugcaaggacuaaaaucaggaaggccuggaaagacuuggaagcauuucugucacaucccaggaacuccguaaaugccagcaaguguuagauuauugugaugauuuuacuacuccuauuauugauauuauaauuaauauuauaauuguucauuauuaccuuauaaaaauuacuuaugauauguuuuucuuacuauuuggugaacaucgaguauaguaccaaguguauacuuuuuuuuuuuuuuuuuuuuuuuugagguggaaucuccugucucccaggcuggaaugcaguggcauuuucucggcucacugcagccuccgccucccaaguucaagccauucuccagucucagccuccucaguggcugggauuacaggcaugugcuacuacccccggcaaacuuuuauauuuuuaguagagacagaguuuugccauguucaccaggcuggacaugaacuucugaccucaagggauccaccuaccuuggccucccaaagugcugggaugacaggugugagccacugccaauuauauacuuauuuuagguguauuaugcugugcccugugcuuuucuuuguuauacuggaaggucaugauggcaggaugucuuauuuaugcuucucuguacucuguccuguccagugccuuucagaaguaagguuuuuagaaagguuugaguuauuuccuguuuucugaaccagacaggcagaguauuugaucuuacaaaaaucuggcucaguucaaguuagcuguguagcuuuggaacggacccuggacagauggauuuucuaaaauuacagaggaaacuagaucuguaacucuguacauuuacuccugugccaguaacaauggcaauauuuuaauacuguaauaaauuuuuucuuaugcauuugcuauaaauuaguaaaucuguguaaagcugcuuauugcaucaucauguagaauuucuacauccugcagaaguuuaagaaaauugucuuccuuuuacagacaaggacacugaaguuuagaagugcuaaguaaacugucuuagaucacuuagcuagcaagugacagggauggaauugaaucuguauuuaucagaggugaaaguauauguguaauuauucaacuacacuuagguaaauauccgcauacaugcaugccuccccuuagacuccauuguuccaaaagguaaugacaacaaaaauuagucggaggcggaaggaaaugcaaaaguggacauuuacucgagaaagaauaaagaaaccaugcaggauuccauuucacaaaccucuacagcuguugcuggggagucaguggagggguacuggaggaaggcagacuuuguucuaagcuacuuagcagccaaggaaagcagaagaaacuauuauuauuauuuauuauuauuaugugaguuggagucuccuugugucauccaggcugaagugcaguggcauagucucugcuuucuacaacguccaccuccuggguuuaaucgauccuccugccucagccucccaaguagcugggauuacaggcacccaccacuacauccagcugacuuuuguauuuuuaguggagacaggguuucaccauacuggcccagcuggucuugaacuccugaccucaagugaucugccugccucagccucccgauguguugggauuacaggugugaaccacugcuucuggccuagaaacuauuauuaauagaaguucugggacaacggcccugcucucauuacuugcccccaauccaugcaaugaaauacuggccugugaguauguggucccuucagcucauuuucugaagcugaccaaaggagcacaguaaugcauaacgggggaguaaaauuccucaagacgagcaaaaaaggcagaaauuaauaaaacucuauguauuaguuaucuaucacugcauaacaaguuaccucaauauuuagcagguuaauacaaugcacauucauuauuuuauagccuuuguagauuaggaaccagccauugcuuagcuggaccaucugcuuuagagucucacaggcugcauucaagguguccacugggcuggggucaacuucuuaccgacaaagcuggugccccaaaagaauggggucuuauccuguugggugucaugaagccaacacacaaaaccgaaaguagugucaagcaguacaggcuuuauucaauggccauggaauugagaagcaggagcauggcucacaaauucacaaaucagcuucuccacuaaugaggggugaggaaguuaaaauauagacuuuguuguuguugcuguuuuaaugaagaggcuggacauuaaaaucaaggggaggaauaaucaugucuucucuugaaaugggcagugaacuucccggaaccagaguguugccuuccuuuuuauccuuuuauggcugcuucugaucauugucauggugauugucaacugucuuggcgcuggugagggggcuguuuagcauggaaauaggauuauaaugacaccugaggucuuuuugaaguccuugggucggcuaucuugcuucuaacaaaucucagcuggucugguuacagagggaacuuuuuaucacagguguccuguuucuuaaagauaagcaguguuauuacaggguagaaauucaccuaugucaaguaggcauuauaccagguaacaaucucaagacucagcagggaaggauccacuugcaagcccacgugcuugcugguaggacucaguuccuuauggcccaguggauugaaggcuuccuuuccugccugguguuugguuccuugccacguagggaucuccaucauggcugcuggcuuuaucgaagcauguaagccaagaaggaaauagaauccauugguaaaaugaaagucacaguucuuuguaauguaaccacggaagugacgucuuacugcuuuugccauauucuuuuuguuagaaggaaaucacugagucugaucguuguuaaaggggaaaggauuucacagugguaugaauccugagaggcaggggugaucagggccagcuaccacacucuacaacuugaauuuuguuuuagauuucagugccuuuuggggacccugcuacauugugguagauuuacucacaggacuugaugauuuuucuugaccugccugaagccauagcauuuauuacggauaaguuugucuuuucuucguucuuuuucuguuugcauccuuucgucauccuuuucuucccucuuucuggacugagagaggcaccaaaugcacccauuuaaaacauauaugcauuucugcuuucugaugggagguaagauuuagucauuuaauaagaaagcuuaugaaaagaauaaacaaacugguagauaauguauccuaaagucaaguauuugcuuucauguugcuuuaguagaaggggcccuuguuaaucgauggcccaaauugucuuucucaagaaauguguauugcagaauuuggauuugaguuacaaaaacuagccagaaagcgugaacuuuuuuuuuuuuuaagccauaaagcuugguaaggcuagccaaucauuucaaagccuguguagaauaucuagacuauauguaauccuaggauuuguuguuguuuuguuaugauuuuuuuuaagcaggaagcuaaaaaaaauaaccacccguuacuuugcugcuuuuagaaaauagguuugagauugauuuugaauacuaaaguauaguuuucauguuauaaagccaaccauguuaaaaauguauaauaaaguaucuaauuuagcaaaauucaaauuuccccuaugaaauaucaagcucuuuuuaugcuucuucacauggcaccuuguguagaauuugaaccacuuuaaacauugcauccuugaguugcauaugaugggaucucuugaaucauuuacauuuugaaaaaagaaagugaaauauucuuuaagaagccaaaguaauccacgagaauguaugguguuuguucagcuggauaucuuauuuauuugaaguacugagagagaaaucuuuucugacugcucaaaacagggaauaauaaacagucagaguguccaaguaaucugagcuagaaaguuccuucuuucagagaaaaguuauaaaaaguauauuugccggauccaaaaaaaauacuguguaucaacuacugagaccugcauaauguuuucuuaguauucucacucuuuaaaagaaaaaagaaaaccuguaaaauuugggaacuuaaacuuuuuuugauauuuuaauauuucuaggcaggugagugcaauaagucuguuuuuugaucuuagaacauaacauuucuuguuggcuauugugugugcuauguguaugauuugucucuuuguuaauucucuauaaauauaaaagagcaaguaaugaaauuaccauggcugaauucugaauauuaacccagagcagauuuccucuaagaaagaucauaagaagaugcuuaaaagaaaacauuauauuucaaaagaauuagguucugaaauauacccaauaaugaaaacaauacaauuuucuucugcuuuuuguccuuccuguuccaagcacugggaaggagcuggcauauuucuuauguaugaaaaguagaauaauauauuggauuccuuuaucccuaacccggaagagucuuucuuggacugugguuugcuuucccguuauacuuaagcuuguuuauugcaucuuccgaugucacauuaucucauugccaagcuaaaggcucuguuggguucuuaguugaacccagaguggaggccgauuucauccaaagccauuuuuuuuaaaauuagaaauuaaacucaccuuuggcaaguccuccugaccagggauggguccucauguuagucuguaaugugaagauaugaaauguauuugauacaauaggagauucacugugauuuucacugaaugaguauacauucugcagaacuagaagauaaagauaauaaaacaauucacauuucuuaggacuaauuuauuuuccacaguccacuaccaacauggugggauggggaggagcugagaagagcauauuuggcugaguuugguugcagaaggaugcaaugugagguagcagaaggggcuguaagaacacaggauuuugaaguugaagaaaccagccuggaaugaaucccagcccuuccuuuuagugaccugcuggccagccacauuaccuccuugggcuuuggauuuucuuuuucacuguaaaauggggaaaguagcucccacaucuuugggcuguuggugggaggugugcaggacacagcugaaaccuuugguguauaguggauacuaaagcaaugcuagucuucuucgugugcuaccaguuagaaugaauuuugcugacaucuuacugguuucugaggguauacagacacuuauugucaaagauauuauugauuaucugauccccaaacauauggaguuacaucacagcaggugagaaauacccuucaacucuugauucuaaggaaaauccuuggggagccgccaucauuccuuccacgaaggaaugaaauuauaacguaauguauuguuggagcccuuaguucaacacugucuuuuuucaggucauauuaaugcaaugguuagcauaucaacuuccuucuguuuuuagugacucuaauacauuauauucaccuuguucucugcauguucuuucuuuaagucauguuagaucccuuuuuuggaagcaggucaaauuugaauuaauaaaaugauuuauguugaaguacaggcauaucccacagaaucucuuaauaccaggccaaaaguaacuuuaucuugaucuguaguucggacauauuucuuggauuguccgcacucauaaaaagagauugcguaacacccuuugaacaaauggauauuugagaaccauccugucuucagauuuagauuuuuucaauuuuuuuuuacugucauaugauucacaugcuaguuacugauugcuaucaugcagucugccagcagaccagauggcagaucuuuuaauuagauauguuuguguguguaugcauguguguguacauguaaucacaguucaucaaggaccuaauaaauacuuuuuucucucucucucuuuuuuuuuuuuuuuuuuugagacggagucuuauucuguugcccaggcuggagugcaguggcggaucuuggcucauugcaaccucugacucccagguucaagggacucucuugccucagccucccgaguagcugggacuguaggcaugcacuaccacaccuggcuaauuauuauguuuuuaauagagacuagguuuuaccauguuggccaggcugguaucgaauuccugaccuccaugugaucggccugccuuggccucccgaagugcugggauuacaggcaugaaccacugugccuagccuuaauaaauacguauuuaugucuuucgaucuuuuucuguuuuucuacauuccguuuccccuauggcugcuauuguuuuccagugagcuauuuauauauauauauacauauuuuugagagggaaucuuacucuguugcccaggcuaaaguaccaugucaagauuauggcucacugcagccucaugagccucaaccuucuuggccuaagugauccuccucucucagccucccgaguagcugggauuacaggcaccugccuucaugccuggauaauuuuuuguauuuuugugaagacggguuucaucauguuggccaggcugcagcuauuuauaucuuauauguguauuuguaaaaaauuuauuccucagcccugugugguagcucacuucuguaauccuagcacuuugggaggcugaggugggaggauuaccuaaggucaggaguuugauaauagccuggccaauauggugagacccugucuguacuaaaaguacagaaauuaguugggcaugguagcggugccuguaaucccagcugcuugggaggcugaggcaggaaaaucguuugaacccgagagguggagguggcagugaguggagaucacgccacagcacuucagccugggcgcaugagcgagacuaugucucaaaaaaaaaaaaaaaauuucuuauucaguugauuuaagaugguuuauaaagacaacaugagcuagcgguagaaaugcgaauggacgcuuguagacaguaaggacucaauacguggguuuguucaaguuauauugugcagacaggcauaugcaguuagaaaaucugucuaggguagggagagauaaaaccagcuacuucagcccugcuauuuuuauccugaagauuuuuuuuuuacucuguuuaugaauaaaacauuuuaaucagugcuguaucaacacugaucaauuuuuuucauggaaguguaauacagggugaauuccauuaagucaauuaaauacuuagauccaguuuuuaaacagugcgaagauaguuaagcucuucuuuuauugaaagccuuuuuaccaaaaccauuuuuuuuuauuuuauagugaagauuucauguaucuguuuucuguacaugccaaguuuuacagcuuuuuguaucaugaguuuucuuuugcaucaauuauuucuaccaaguccaacuuguagauugggcagaucuggauuucaccacaccugguuuuuguugucauugaguuuuugugauggggugauuucagugagaaauauaugccauuaauuugaugaaaaaucaguauuuauuuauuaacuaauacccaagaaauuccccagcaagccucuuccaguauucuagaguuucucguuucuugaggauuggucuccgggcauacuccuaaucuaauuguuucccaaacuuucaauguuuuggaugacuuuggaagccuugauuucuguaggcuguagcaggacaaauucugauggacagaucaagauguucuauguugcucuaaaacagcaucucucaaacuuuuuuggaccacuaucuaaguuuuuucuguuaaaacccaauacauuuauacuuauguauauucguguguguguguguguguguguguauuauaugcauguguguguauuugucugaaauaaaaguuuuacaaaaugauacuuuuaucugagcaguguccugcuguuuuuuuuccccuagguuguguuuuuguguuuuuguuuguuuguuuguuucuuuguuuguuuuugagacagaauuucacuuuuguugcccaggcugcagugcaauggcacgaucucugcugaccccaagcuccgcuucccaggaucaagcgauucuccugccucagccucuugaguagcugggauuacaggcaugcgccaccauaccuggggaauuuuuuuuuguauuuuuagcaagguuguugaucaggcuggucucgaacucucaacgucaggugauccauccuccucagccucccaaagugcugggauugcaggcuugagccaccgugcccaccuguguuuuuuguuuuguuuuuguguaugugccaaugaugacccaguuucaauaccaacuguugcuuucaccacccacuauugguuucaccaccccgcuagaucacagucuguucuuuggcagucacugccccaauacuguuugaugugcuccccucugauaaauguucauugagugccccacaugucagguacugacuuaaggcauagcaaaugcaaaaaugagcaagguguucucuuggcucuaugggugccuaccuuagaaggauggagaugggaagaaugugaaagggaggugagaugagcagcacugggauguguggcuuuucugucuugaggauagauagaagaggagucagauaaaguugcagaacagagaugacgucuuuacugagacuugaaugaugugucggaggcaaacauguugacacaaacgagagaauuuuagguucucuuuguagcuguggcugggcugggacaaggacgauggacaaaguuaugggggugcuaaaaaccucaguaaugaagauaaaugauauucuaaucuaauauuuuaaaaaaucgaggcuaggugugguggcucaugccugugauuccagcauuuugggaggccaagguggacggaucaccagaguucaggaguuugagaccagccuggccaaaauggugaaaugccaucucuacuaaaaacacaaaaauuagcugggugugugguagugugugccuguagucccagcuacucuggaugcugaggcacgagaauugcuugaaccugggaguaggaggcugcaguaagcugagaucaugccacugcacuccagccuggguuaacagagcaagacucugucucaaaaaaaaaaaaaaaaaaaaaaaaaaaucaaaauugaugcaaaaaauaugauaacauuucaaaauuuaaaucaagacaaauucaauauuauagcaaagguucaaguaaugaacaugaauuuguaaugaugccugggggaggugaagguuaaaaaaaaaaaaaaggccaccaaggaccucauguuaaaguugaugaugacggaagugagcagugaugaugagauuuaaaaaacuaacuuuuauuuuuacauuauuuuaacuaguauuuguguuaacauuauuuuaaucuccugugcacuuaagggagcuggcauaggccggcaguggcuauaggccaggaccugugcuauguagcuuaucuauuucucaugcugauucuacuuuuguuacuaccgaaggagcuuagagggaaucagugacguggacaaggcuauguaacuaaaggggguggaggaggauucaagccccuugcaacggacugaagugcccaagcucuaaaucccugccacccacagccucuguuggccccagguugugucugagauucagagguuguuuuuauagcagcaacacaguaaguugggaagagggacacauuuuuaacauagacaccaaaagagaggcuggaagaguugaccacuuagaaaugucacgagugucugugaauaguguugggggcugagaggcaagagaagaaaauaguccuaauguuguacaaguagcaauggaaacaaacuuguuaaaaaaaauuuaauuuuguuuaugcaugugugcauaaacaaagcaauagaaaauauuugauauuuaagauugagcacuuaacaaaauacuuugucucuuuuugguuugcugucuuaagcaauagccuuaaauucuugucccagggauaccugauagagcuaauauagaacaauauuuuaacauaauuugaaguauuuuuuucuucugauggguauguaguucauuuuuauaaaaaaauuuaaaaauucugaaucugugguguuucugaaacauccugauauauuuuuuguugaugacucuuaacaaaggauguaagacagauucuaagaagagaaaagguagaauauccacaugucucaguuucauaauauguguaaaaauuaucaugcccauucauuauuuaaagugcuguggcuuuuuagugaauaccaacauuaacaaaccauguuaacaugauuuaaaauauguaaugaaauuugcaaugcaucagaugauggaacuaucaaauuaguucacguggcguuggcugaucacccuuaugaagaguuacuugcauuguuugaagagggaagaugcacauccccuugugggcuggcagcauuuuugcuaacacugccuuaaaugaugcuacuggcaggaugguuaauuugauguugaaaugucacacaauaugugcccacccuacgauuugaaucuucugugccguuaagggaauuggcaguguucagacagaaugguaacauucucucugaucgugucugugucugcacccuuuuuuguuuuguuucuguugucuucauuaauagaccuuucaggaaccuuccugggaucucagauaacaguucuucuggaacaggauuauccagagguagcaaaagcucuccugcaaauauuccauugcacgacuuuaaauaaagcagcaagaagucuuuucauucaguucagauuugcuacuuguucucuugguuccuucaaaguaaugacuaaguacaggucuuuagauagagagcugcaccaaccagguauugcuucgugucuuccacguacguccugagaaagcgaaggugaauuucaccaauugguagguggaaauagaaaaacuguugauucuuuuuuucauucaccaaucuuuuuuuuccccaaaugcuaagcuuuauuuggggaaaucuuaacagccguuuuuauaagacucugcauuuacaacauuugugggggcugcagaggacgcacaugaaaauaacaugaacuggccauguacgguggcucaugccuguaaucccagcacuuugggaggccgaggcagguggaucaccugaggucaggaguucgagaccagcuuggccaacauggugaaaccucaucucuacuaaaaauacaaaaauuauagcugggcgugguggcgggcgccuguagucccagcuacuugggaggcugaggcaggagaauggccugaucccgggaggcggagcuuucagugagccaagaucgcccuacugcacuccagccugagcgugagacucugacucaaaaaaaaaaaaaaaaaaauuagcugggcguaguggcaggugccuguaaucacagcuauccagaggcugaggcaccagaacugccugaaccugggaggcggagguugcagugagccaagauggugccacugcacuccagccugggugacaaaaaaaaaacuuuaccugggcuuaguaaguugccugacuucucauccuggaguucguauccccuuguuucuagaagagaaaucccucagaugugaagguguguuccaugauuuugucgaacuugcccuacauacuguuuuauuauauauucugcccacuucuauucccugccaauuaauuaauuguuucauugguauaguuuuuuuuuuuuuuuuuuuugauacagggucuuacuguguuauucaggcuagaguacaguggcgugaucacagcucacugcagucuugaccucccaggcucaagcaauccucuggccucagccucccaaguagcugggacuauuggcaaugccaccauguucggcuaauguuuuuaauuuuuuauagagacaagguuucccuauguugcccaggcuggucuggaacuccugugcucaagccauccucccaccucagucucacaaagugcugggauuacagguacaagccaccaugucaggccauugguauaccauuguuuuucuuaaacauuuauuuauuuucuuauauuuacagcauauguggucauuuaaaauuauuuuauagcauauaaaaguaaaaagaauauaaauuaauuuuuuagcauuaauauuagggaagauaaucugacauuuaaaaauacaugucuauauguguauacauacauagaaguauauauauaaauaccaguacuagugucugcuaauagguggcgccacuuuuuaucuguguguguuggggguggaauuagcauguagagguuggcaaaggggacaggagacugugggaugauuaguauauucuuauuuggccugggagggaaaaaaaaucuuucauuuccaacaauauucauucucugugucaccucagcauuuaauuuacuuccgucacaaaacuacuugaaguugucccaggcuaguugguccuauuaauuacaaccuagagggauucuauuaguaaacuaauggauuacaguaccuaaauggaagccagcagaugacuuuggaaggacugauccgcaagggccuucugugugaagauuaaaugaagcuuccuuuagccuucucagguggccacaguuucccauaaccuuagagauuaucuaggccaaggcuauuaauuuagagauuaagaagccaaacccagaaagguugaaagacugucguaaguucacacugaaagagagugguguaaugcccuuuucaccaggcuccaagaaauuugccuauuuuauguuuuaacggacaugguauccccagcauuuuuaauaaaugcccuuuucuugcauaaguaacuggauauuuccgaguggccuacaaguggagcgugauuucaucuuucaucaagagaagcagcuuuuccuccucuuguauccguuuucuuccuuuucuaacuaucaaggucaugcgguaucugccauuuugcauauucuugcuuugcuucauguuuuccuuaaacucugugcacaugaauauuugugguauauggcuuaauuguaagcgaucaggcaucaauggcuuuuuaugaggcaaaaucuacuuucugcauuugcgugugccauuauuauagauugcugauguuugccaauggauauucuuggaagucgucuucugguuuaaaugcaguuaaguauuuaaaaauaauaccagugacauguuugcauuuacauucagccugaaggccuacuugaugcugcaacugaaaaauuguuagacuagauuuuauuuuauuuuaauucuuuuugagacagggucuuagucugucacccaggcugcuggagugcaguggugcaaucauggcucacugcagucuugaccacccuggcucaggugauccucccaccucagccucccggguaguuagggcuacaggcacacgccagcacacccagcuaauuuuuuguauuauuuauagaguuggguuuuucaccauguuguucaggcuaguguugaacuccugggcucaagcaauccgcccaccucggccucccaaagugcugggauuacaggcaugagccacuguaccuggacuccacuaugccuuccccuccccuucccucccuuccccacccuaaagagucucgcucuuuuccccaggcuggagugcaguggcacuaucugggcucacugcaaccugugccucccggauucaagagauucuugugccucagccuuccaaguagcugguuuugcaggcaugcaccaccacacccagcuaguuuuucuauuuuuaguagaggcggaguuucaccaaguuggccagguuguucucaaacuacugaccucuccucggccuugcaaagugcugggauuauagguaccccgccuggcugauacuuuccuuaguuguuuucaguguaauaaccugucuucagucuacucuuuguccuuuucucuccuuuccucccugaauacucaagcuuccagugcacagauuucuccaacccugaaugugacugauaccaacaccauacuagcucuuccacagaugccuguuuguuuugcagaacacuggccugaaugacucagacuuggagcuugaaagagggagaacugauguggccuguggcagacguguccaaugaccugcuguguccuugcuuuugaagaacuaaagaguagacuugaccacuuuuuaaacaugacauucgauccacguggcauagcaaggaugggauccacaagauggagugaucuuuacgccauccuccugaccauaaauacuaaaugaauacucuauuucaguugaguuuuuaguuugcucuguuacgugaggacacaucacuugcaccucagugugaguuugaaaguguuuucucuggagaauaauucugaagaaauaggcccuccagauaucaguagugacagggguaucaguaauguugauuacuaaguucuugccacagguagaagccaugcuacugcacaaguuucauacuugaagaguggacaucugacacaguguuggugguuguugaaguguaugacuauuacuguguugcuuuggaagcuugaugccauaacaaaagugcagaauuccauguuugauaacuuucugacuugaugaaaaugaauuguggauacagauuucacuauccaugaauuguggccuuaacuuucucauguacuuacuuuaaaucagagagcccaccuguccaauucuagcuucuccugggcauccuguauuugacacagccccucccagcauucugagucaucgucugcugcucuugcacuguccguuuuccaaaugaggaacucaucgguaaggccagaaaggaaagggagaaaaaacaaacaaacaaacaaacaaaaaauaggaaaaaaagaaagagcguauuuauagaugguagagaauucugggcaugagaaacccagccaaacaaguggaaugugugcauaggugggacugcugaucuuguuuuaugaaagaaauaaaggcaagucaaacagauccuuucgcaaggauccccauguguguaugucuaacccagugacagguaaggcagccaggagcugcuguuauuucagugcaaagcuguuuucacaaucacagacaugcacagcucaaaaacccucacaggucacgccugaauaccuucaaugugccccauguaaaaauacacugcaagucgauuggacaugcccuaugaauuauaccuuauuuaugaucgucgagcccucccuuuucccgucaugcuuuagaauuaugggcuggagcaguuuuuaauacucuauuuauuuuaggggaggaaaauguuuuucuuuaaccacaacauucaugcaauaccaacugcuggcaguuuccccagcauuuaaggaaauauuguuguaagacuuuuauguucuguacuucaaucagcuagagccagcaguaucccaauggaaggacccucaacagaccauuuucagcauuuugcuacaauuaaacuccucugguuuuagcccucaggcaauuuaguaccuuuuuacauaugcacauuaugaacuuuugaccagggucuagcagucauauauuagaaugcugcucuugaaggcaggcuuaacaaguuccucugaguauuacaguuggagucaguuguggaaaagguaauuuaagcaacuugcagcgaggccauucagaaucucagcgaugauccuaaauaucuuucucucuugcucacgcucuuuuuuuuuuuucuuguuuccucuggaagcugguagcaggagcuuucaaagucugugauugaucuuuuauucaguagcuaacgagggcugugauucuauuagcgcacuacaaggcaagagaacagugauuuaaugaagugucuagugagccggccauagauuuauccuguugucgcuaauuugcagcgcacuugccagcauaaaggaaacugcacucacacugcuauuaagcagguauuuccuuaguaaauuguuguaaggucagguacaguuaucugagcaaaagcaaugccuuaccucuucagugucugcaaaugacagccgccgugcugagcgcucacugaaguggaaccgggagaucagagguccgucuccaagucgcccuuagcggaggcaggagcagaugaacugccaaguaggaguaauagagucauaauuggugauuagaacuggaaaggugcaauaacaucuuaauacaaacuggcguauguuauaguuacugucaguuguuguaaacucguccugccgccuggacuaguuacgcuucccuugauuagcucugagaaacgaggcagcgggcacuggggcagccacauagacaacaucuaaauuuuuguugcuuuccugggucuugcccuguccuuacuguuucccuugggcacgcuguucaccccuuaggacauacuacaguaaccuuuucccaccaccgugggaggacugugauuuuguaaauguccucugaucucuccucuuugcaggcgcagugacauuuaugcacacuggcuuugaggcucauugaucuuuuguuuuauuugccuuugcugaggcaggggcaggucuuuguuucaugucagauccguaucccacugcaauucuguguuacuguaggagauuugggguuggcaugccagagugaaaacgcgaaagaaaauaaacaggcagcacugaggaauuauacacuugagcuuggcauuuuucuuaacgcagggcuauuuuaggugcacugcgcauguuggaggugcccuugcagguauagguaggcauuguccauccgugguaaaaagcaauagaagaaauucuuacccgaugcuuaaugaauugccaggcugguuaaaaaggauaacccuugaaaccuaggguguccaacugcuaauuuauauagacuggagauauuuccaugccucgcagcaaaauuuuucuuuaaauucacagaagcagcagcuauccagcauuguccaguugugcugaguagcugucauuauugauaaacauguaacuggucauuuguauuguuuugaguaggauauggcuuaucaggaugcauaguagagaaaaaugagaugagguaaugagaucacauacacugaagcaucuuacgaaucuggcacauaguagguucucaauaaaucuuuuuugauucugugacuguuagaaucuguuggcugauacucugucaucuggcucucacucugcuccauaaaacuuggguaauucuaaugcuuacuucaucccagggcugauguguguuagguuaggguuuaugaucaaguaaagaguuuaaagaaguguuuuaugagggaguuuuguuugcaaaugaucaccugguaauuuaagagggugagcuaaacuuccuccuuuucuaguauggaccuuuggggcucaggaugaggauguucaauuuguacugcugguggagcugccuuuccauuaagugagucuuucuccaagggaacagaagucuuagguuguugaucuggcggucagaaccuaggacaggcaaggcagugggcuguuguagaggagaugaagcugaucagagcacacccacaccagugacaaccggucaggaccugggaagggcucugacccauucaucugagagauguggcaugaggaacacugagaccuaaugcuuauugcuuaauauuguggacaagggacucuguggguugucuaguacuaagcagaauggaagggaaggauggaaggaagagagggagagacggagggagauggaggaugacagggagauggagggaggcaaaaagaaaaagggagaaggaaagagaggaaagaggggaagggaggaaggaaagaagagagagaaggaggaagagagggaaggaggcacagagguagagaggcagggagauaauggagauccuggccaaaaguuaaugcuccguuucuaguaguccacagaaagcaccuugaccaagugacugaauacaaaucguaucacaaacuacuaggauuucuugggugcuuaccaugugccauauuuccuugaaucuucaugacgauccuucaagggauccuuguuuucuaaaggguaaaggugcagguuagaggcuaugucagaagcaagucaggauuugaaggcagaucugucugcuuuugccccucuguaaauccagagcugcugccucauuucuuacguugcccccacccgugcagcaauucuuccugggaggccucauuguucauauucauaaagggccccauucagucuccuuuuuggagaaauggccacugcaacucucuguucugaccuggggggaaauguuagacccucaauaaggagaaucagagaaagaagaaauaaaacauauuacuccauucccauacuucugugaagaaauacccgagacuggguaauuuauaaagaaaaagagauuuacugaacucagucguuucaccuggcuggggaggccucaaaauuauggcagaaggcaaaggaggagcaaaggcacaucuuacauggcagcagacaagaaagcgugugcaggggaacugcccuuuauaaaaucaccagaucucaugagauuuauucacuaucaagggaacagcacaggcagaucccauggcuuugacucaguuaccucccacugggucccuaccaugacacaugggaguucugggaacuacaguucaagaugagauuuggguggggacacagacaaauuguaucauagaaucauaaaaauugcuauuucuaaggcagaugaauaauccugguuggaaaucauacugauuuagacuuaaaaccauucagccuucuuuaccauuucugaauguggcccugagggaggauuugucuuuugcuauuuucuuuuuuuaagagauggggucuuguuguguugcccaggccacucuccaacuccuaagcucaagcaguccgccugcaucggccucccgaagugcugggauuacaggugugagccaccacacccagccugggggaggguuuguuaaagaacugucuguuuuaucacaugaccacaaguuaaaauguugggcaaugucccugaaugauaccuuuucauuaguaacucacauggacccauaaucucugaauuuaacaugcuuuucaggaauguguucauauuuuccaccuauaaaaccuguuuuaguaauuuacucccuuguaaauguuccuugguauguaaauuuagcauauuuccuuuuaauugcccagguaaauaauacccaccaucagagggcaccaguaguguaaucaccuuauuuuuuaaaauguauucuguguuucaugauuuuuucugaauaacugaucuuuacagucugaauugcauucuguugggcuugacuuauuuuuaaauuaaaagagacuaacacauuaaacacuaagaggucacauaggauauuccauuuauauaaaauaugcagaguaggcaaauucauaaagacagaauacgcaucggugguuucuggggcggcggggaguauggaaagccuguuaaugaguacaaguuucuuuaguuuuuuuugguuuuuuguuuuuuuuuugagacggagucuugcucuguugcccaggcuggagugcaguggcaccaucucugcucacugcaagcuccgccucccagguuaaugccauucuccugccucagccuuccuaguagcugggacuauaggugcccgccaccaugcuuggcuaauuuuuuguguuuuuaguagagacgggguuucaucguguuacccaggauggucucgaucuccugaccuuuugaucagccugccuuggccucccaaagugcugggauuacaggcgugagccauugcacccggcuauuggguacaaguuuccuuugggguggugaaacuguuuuggaacuagaggugauagcucuacaacacugucaauguacuaaaugacacuaaauuguacacuuugaaauaauuuauguuaugugaauuucaucucagcaaaaagaggcuaacacauaaggagacauauuuugauacauguggcauauuaagcugcuguuguuguuuuuuaaauauuccagcugcgugcaguggcucacaccuguaaucccagcacuuugggaggcugagguggguggaucacuugaggucaggaguucgagaucagccuggccaacauggugaaacccugucucuacuauaaacuccgucucuacuauaaauacaaaaauuagccaggcuuggcgcuggguuucuguaaucccagcuacuuaggaggcugagacaggagaaucacuugaacccgagaggcagagguugcagugagccgauaucucaccucugcacuccagcgugggcaacagagcgagacuccgucucaaaaaaaaaagcacaaaaaauuuuuuucuuccaucuguaucacacaguugcaacguuguagcaugggcaggaaauaauuggguuguauguaaugcccaguaaaguaaacagaucuuagagagggacaccgaucccuacccugcaugggguuauucacagagccauggggacacuaaacguaccuuaucucuugaccaugcuauugauuaguuauguguuugccuguguuauuaauaauguauacauugaaaaaucuaugugcauuauagucuuugaucuugucaugaauuucaaagccaaagauuccauuuuccuucuuuuuaaaaaaaauuuuucaaagagguaggcuggaaguaaauuuaaaaauuuuccccuuucuggcagagggcuuuuuucugaucaccacccauguuaauuagauaugcauguauguguauguaugauguauauacccauauacacacagucuauauauacauguaugcgcacauacacauauuuuaaggaaagaauuauaaaaugaucaauucaagcuuacuauaugcuagaggugaggaauauuugaauacaagucuuaucuaguagauuaaaacagaaauuaaagacuguagacuaaggcaggaucaaaggaccucuuuucauuguucuuuuauuguuuauugacuucaaaaaagacuuuuuaguuuaaacugacuguaaugucucuugaauggucuuuuguaaaaugacuuugaaaacucggggauaaugucuucauuaaguggagaaaaaucuuggggaaaauauaacuguaacuuggcuuucauuagaguagaaagagauaaagcuuugcuuaauuaaugucuguuuucccucuguucagaaguauaaggaaaaaggggacugaaauuagugcugauaaaagcuugaauuagacauuauagcacugaaacuucuuuuucuuccuuacuuagaauuuggaagaacauacuucauacaaagcuaugaagcauauuggaagauuuuaggugcccugucuuccuggauauaaaaugacuccaaacucagugauacugaucagccuggcuucuuuuccaccuuucucacuucauugucuuuuuguguguuucugacaucuguugacaaaugggcaaucuuggggaugggggguuccacugguauauuuucuuuacuguuuaagaaagcucaaaauucucucugcucuuuuccaagccaccaaucaaaacugacauuuucuaaguguccucauugcccucugggaauguucauggccucugggaguccaagaacuaccuuuacacuggaucuucacugcuuuuacuauuguguggcuuucuaccaguucucugcucagcuucucuuuucuggagaccugauaugcuuuguuagcuuagcaugcuguucuaggcugccuuucuuuuuuuuuuuuuuuuuuaaacuucauggugagcagaacacuguacuccagacugugaggccccaccugugcagccugcuggcuucucauaccagcuuccuucucaccuuaaccccacguauuguugcaacggcaaaaaagagaauugcacagaggaacaccaccuaucagaguucacacugaguuugcagauucauccuuuugcuuccagccaucccauggaaugcuguucuuggaagggucaucucaugguccauugucggcccucuuagaagagauuucaggccuucccuuguagcuugauaguuacagggagugcuaggguaaguggaaaaagcacaugacuuggaauaaagacuuaguacacaucccaugucugauuuauacuaacuaguucauggaccuagccuacguuacugcaccuguuugagccucaguuuuccugucugcaaaggagggaugaugguacuuaccucaaagaauuguaguuggaucaaaugaguuggagugggauacagcaacaaucuauauucugauuucagcaacacugugcaguguaauuccauauuauauuacaccacaucuucugugggucuuucuuugggggaagcuaacauuuuaaaagguuucccuuuguaaccuguaacccccucuaccccaaaaguauauucaagagcgaaacuuuugguaugacgaugucuuacaucaguaguucugaaugacuugacuuagcuaucuuucuugagucucucaaaagacagauggauggauagauugauuuuguuguaacaccuguucaguuuugcuggccuuacucguuuucaaauacucaaaugccauugagucagauuucagaggcaaauggugauaccucagguuugaaguugcaagaagucaccacaugcuuguuauggaaaucgucagggauauuuauucccucuccugagaagcauaauugagccuccaaaccacccaucaagauauccaccuguaaaauauuuaagaacugguacuaugaagacauuucccuuaugcaauuuguuuuccaucuaagagcagaacaaggaaaauauagcugacuauaaguuacaaaggcagacucuuaagcuacaaaauacaucucuucacaggagcacuuggagaagggcugaaggcaaaccaaaagugagcaacaaggagacuaguguucugaaacagagaugacaggcuccgcagugagggugaugaugguguuacgaauuacccauucaguuuaaacuagacauucccuggaagcaugucauggggugugcagaagggcuuuuggauaaaaggggucuaguuaagagauguuaaaaaaacaaacuugaaaagcauagcaggcugccaggacaugucugaguaccgcgcagauaguggggaauagucuauggauucugcuuacaccauggacaaccaggcugggccauggguuguguuuuuuuuccucucauuuuauagaaauguuaccaggcauauuuucccuguuucccuaagaagagcuuccucucagugcuagccagccacagggccaagugacaccuagaggugauccuuugguuauuugcuaaacagaucuaagacaaaccgauaucuguaaccugggauuagauagagccaauaagauguaacugaaauucucagggauucuaagacaucuacauuguauguugguacguuauugaaggugaugcuagcugcuauaacaaauaagcacgccugugcacaguugcucaaagauaguagaaguuuauuucuuguuuauguaagauccauaaugacucuugccaauuagcaggcugcucucuuccaagugguaacccagggacucaagcucuuuucaucuuguggcucagccgucugacacauguggcuuccagcacugcccugcuguugucugcacaaagcugguggaagaaguaggaauuugcaggaccauguguggagcauuuuaaggaugaggccugggaguggcacaaaucuuugaacuccaggaggcuaggaaacagagcauaaccuugugcccaggaagaugcggggcauaguacaucuuugccucaccugauguauuguuuguuuaaaaucacuuuggauucucauuuaccuuuucccccucaagaucuuuguuuuugacuuuggagauaaccagaaauaacuaagcaugcuuccuucccucuacgauuucauccucauggggaagcaagaccccacucuuuuauuuucauguauguauauauguauguaugcauguauguauguauguuugagacagaaucuugcucugucgcccaggcuggagugcaauggcaccaucuugacuuacugaaaccuccuccuccuggauucaagccauucuccugccucagccucccaaguagcugggauuacaggcacgccaccacaccuggcuaauuuuuguauuuuuaguagagauggggguuucaccaugugggccaggcuggucuugaacuccugaccucaggugauugaccuaccucggccucccaaagugcugggauuacagucaugagucaccaugcccgaccagcaagaccccacugcuauuguccagugugguagguaccuuugccuaccuucuacucuacaggcuggaacaggugauauugugccuacuucacagccuuccuagcaacugaggauggcuguaugacagauucuagccaucaaguaaaaucagaaaccaacagcacguuuccuugaauaccuuuugcuuucuauaaaaugguguggcauugcugguauuuucacucuuccuuccuacccuggaugcugauuugaugcuuccagccuuagcgguuuucuugcuucuaggacugaacagggaagagggaaaagucaaaagaaugacagaagguccucacguugcagaacacugaccaauguuggcaacuacaagacaaucaggcgugauucuucauccaggaucugcuuuucccuguccugccaauucuugagcugcuaauaaacauucugaugcaaacauggaauacagauuucagagggauucuggguagcccucggagaugaggaugcuuugcgaauguaacaggcaucucucaccucauuugucugguggaauguuuacaaaugcuaauuaaguuuugcuucaaauggggaacaguccugugcaguguuucuaggaaguuaccagcuucaucauaggaagacguucuccaucguuuggaucuuuuucaccagcaccuuuugauuguggugguuugggaugugaugaucucagaacuuuacauccuccaugaaaucucugcagcgauaguugaaugucuugccuuuucuauuauugcccuuuuucuucugugacuuuguacugagacacauuuauauuaggguaauggccucaugcuauuugaaaaucuuuauuugggccacauugguuggaagauaaaaauauauaagcaauagucccugaacaucauuuggccugaacuaggcuagaguuucucuuaaucaaaauaauaacgaugauuuuuccaugccaaggaguggugucauaucaugaaguagauuuauguacacauuaaauaaacuuuuacauuuuaauguaccaauuugcaauuuuuuuuucuauucaccaaaauauuccagauaacgguuaucaguuuuugauucuacacauacuucaaauacuauuaaugcaaaauccuucuuuagaaauguuaccuaauuccaauguuucacuuuauucagcgaagacauuccuuugauuauucugguuagguguuaugaugccaauuugcccacacauuuuuucuuaggcgccuaugcuugcaguagacagagaguugaggaaagcucaagguuaaaacaggaaaaaguaacacaguaaauaccuauuuuugugcauaauucaaauuaaaaccccaaccaccuagaagcaccaauacaaggaacuggcugcauauugcauuccugugaccugcugucuuaaugauggaaugacuaacgaggaucagagggaauguggucagccucuuaucucauaagccaaaugcugcauauuccaagccugucaauucugaaagcccuuguucauuuuuaaauaaugaaaaacuuuggggccuuguucauuguuucuaaaggaagacauuuagaaaauuuagaauauaaauuucuguuaguagaaacuaauuucucuugcuuuucucuaaaguauacuugauuugaaauaugugcccugaaguuuugcuauguugaaaaaaaugaugagccgggcacaguggcucacgccuguaaucccagcacuuuggaaggccaaggcggguggaucaccugaggucaggaguuugagaccagccugaccaacauguugaaaccguuucucuacugaaaauacaaaaauuagccaggaauggugguacacagcuguagucccagcuacuugggaggcugaggcaggagaaucgcuugaacccgggaaguggagguugcagugagccgagaucuugccauuguucuccagccugggcgacaagagugaaacuccaucucaaaaaaaaaaaaaaaaaaaaaaaaaaauuaugucauuucguugucacagcgucagcagaauaaaucuuagaucaagaugggauuacugcgccacucccuucuucccagucugugguuuagcacgggaaaaagcaaacuagggcccuugggccaaaucugaucugcagccuguuuuugugccgccugcaggagaacauuuuuaaauugcugaaaaaauaugaaaggaaaaauauuucaaggugugugaaaacuacaugaaguuuaaacuugaguguccuuaaguaaaguuuuauaggaacacaguguugcuuaucuuuuauguaauguuuguuugcuuugagaccgagucucacucugucacccaggcuagagugcaguggugcguucucugcucacugcggccugcaucucccacguucaagcgauuguccugccucagccucccaaguggcuuggaguauagacacguggcaccacgccuggguaauuuuuguaguuuuaguggagacaggauuucaccauguuggccaggcuagucuugaacuccugaccucaacugauagacccaccucagccucccaaagugcuaggauuacagacaugagccgaccuuuuuauguauuguugauacaguaugacaagggaagaguuaacugauugcagcagguuagagcacagcaugaagagcugacaauauugaccgacuggcccucucagacaaaguuugccaacacccaggugagcagauacacuuaucugugagcagacgugauucaggggagauuguugucccuccuuuccuaagaaaauguggaaagaugagaauguugccaccagugcugauauggagcguuuuuuuuggaauugucuuaaacaagucccaaccuugacuuugccuguguacccuacucuuuacucccaggucuuugcaagguaagcugucagguguuagcugaagauacggcagcccaccagugguccccugaaugccaacaagagucaccucuaagaugauccagcuguugcaugguguagcaugccuaguccuugcagcacacacgcugccauucuucuucgccguuguuaccguauuaauuuagggaugaugagaaaguggccucccuuucccuguuaauuccuuggaggaacuucuguucgaaaugaauagucuugaaauaugucauaaaguuaccuaucaggaccacuuuuacagagauuuaaaugugauaauaagaauaaaagaaaaugaagugacauugaggacgucuucuuuuauaacagcucuaggucuugccuguuaagcacgcuguaaaaugacuguuacacguuuauggauugaaaugguucugcugaaauuuuaaguguuaacauuguucaaauuuucauuacuaacaccucucacauuguuagaaaacaguuuuauguuugacauuuugaucauacuaaccugggacauuuuaugcuaaaguucucauuucaugccuuaggaauccccugcuuauuuugauuucagcaccuuucuguaggacgccaauagcuuauguuugcacaucuuaccccgaugcacucucuaaaccgaucaucacagaagauauuuuguagugaugaagaaagcuuaaaugucucauuugucagauugguuuagguagaaaauaaggauuuccacccccucaucgugguucccuuuuagauuuucuuguuugcuuuucuuuaaagcugcuguuacucaaacgacaguccguaaacugcacuuuauuuuuuauaacagcuuuauugagagauaauuuacaugcuauacaauucaugcauuuaaaguguacaauucaauggcucagucuauucagaguugugcaaccauugccacagucaguuuucuuaccugaaggagaaagccugcaccccauauuuuuuaccucccauucuccacuucaacucuuccccagccucugcgaaccgcuagucugcucuucaucuccaugcguuuguauauucuggacauuucucauuaaugggcucacacgauaugugguucuuugugagugguccuuucacuuugcaugcaucauguuuucaagauacugcaccuaauuuuucaguuccuuguuuuuucuuacaaauacauuuuucaaaaugaguaaacauauguacaaaaauauuuaauuuauuuaggcacgccagguuuaugagauucaucuuuguagccaccaagagccacuaacagugcuaacauagccaggcauucuaaauguguuugucaggugcauaaaucugugacugauaaaaccacugcucauuacuugguucuuaaacucucccucaauauagcuguagggacaugcaaaacaaaggcuggcucauuaauaggauaugucuagaguucugcuuuagaaaucauaauguggacaucauugauuucucugaugcuggaagcugcugcugcuucuucaucuuuaucuucuccucccuguguauugagagcagggaccuccuugugcuguuuugggcucuccuuguucacccagauuggcugcaucagcaccuucuuaaaauauuaguguugcugagauaggagcuuuugguagauggauaaacugggauuuguaaauauuuugcuuaguuuuuuucccagaguuuugcagaagagaauaagguguugguuuguuauaaggugguccuuuauaaaguuuagaccuauuuuaauaaggcugacuuggguugaagauaacuagagccaugacuuucaucuugauggacaaugaguacucacucuacuuuuuuaguuuauauuuuuauuuuaguucauuucauuuaagacagcgucuguuacccaggcuggagugcagugacaugaucucggcucacugcaaccuacaccuucuggguucaagugauucugaugucucagccuccccaguagcugggauuacaggcaugugccaccacaccggcuaauuuuaugcauuuuuaguagagacgcguuucaccauguuagccaggcuggucuugaacuccugaauucaaaugaucugcccaccucaaccucccaaaaugcugcgauuacauuuuaaaacucuaccuuuuaaaaauuagaaccuggacaaagagguauuaaagaaugugucucuuauuaauuuauuaugguaaugagaagaguuuggauuuggaccuaccuagguuuuucuuuccuccagcuccgccaccccaacuccuuacucaugcuuccucuguaaaaugaucacuccccaguuugacaggaauugccccuggaaucccaucugguguucuaauuguuaccaaauccaggcaaaucuugccugugauacagguggugaagcuacuggauagaacuggagcaucuaacuggugugagaugguaucucauugugguuuugauuugcauuucucugauggccagugaugaugagcauuguuucaugugucuguuggcugcauaaaugucuucuuuugagaagugucugaucauauccuucgcccacuuggguggaugaagcuggaaaccaucauucucagcaaacuguugcaaggacaaaaaaccaaacaccgcauguucucacucauaggugggaauugaacaaugagaacaguuggacacaggaaggggaacaucacacaccggggccuguuguggggugcggggaggggagagggauagcauuaggagauauaccuaauguaaaugacgaguuaaugggugcagcacaccaacacagcacaugucuacauauguaacaaaccugcacguugugcacauguacccuagaacugaaaauauaauaaaaaauacauauuaaaaaaaaaaagaacuggagcaucgacuuucguuuucauuucaagacccgucccccaugaucacagaggaugaaaagucugcuuaaauuauaagcuagcuaauugcuucuucaguugaagaccuaaaugaguuuuaaagugaaaugcauaucucuaagggcuaaguagccaacacaauaggcaauugagauaggaaagacuaauuuagaaaagguuguuuuguucguuuuucuuuuuccuucccucccuuccugauuucccaucuucuuccucccucuucucuccccucucccccuucuccuuuccguccuuccuccuucaguucccucuuuccucuuuuucacccuuuuauuuaacauuauaaauacgaugggauugugucugcgcuuuuguugguaauuaaauaaauuauuuauacauuuaacacaaucuugaauuaccaggugaucaucuuaggcacucaaaagcauaagagcccuugaaagcaauaucuaagcauagauauuccauagcacgucuuacaaucuaaauauugcuuuuaguguaaucgaagcagcaagaguagucacagcaguugauggacuauuuuucaaauugauuucaaaaauguauuuaaggggaugaucuucuagucuagauuaccuauugauuuuuaauaugaaaagcucauuauguaagcaguaaccgcauauaaaaaccuagcaaaccuuugcauaaauccuuuaauugaauuuccagagccugugguucuacuuuuuuuuuaauuaaaucuauuucuuuuuuuaaguguuacuguguaauuugcaugcugugaagaggcccugucccagauaaagugccauugauccuuauuaaaccucaccucugggcuugcuuaaaacuaacuggaaaaauuaaaguguucaugccgcaaugcacuuauagcuugugugauaggauuauggaaaaaauaauaaaacuaauuuccaggggagaauuucuaaugugagauuuuauuuuuuuucaauuugauaauuaauagugaaaucauaucauauauauaaaucauauuuuagccuauaaacugaaauggcaauuaggaaagauaauauauacuugauguaaaaccauguuacgugcggauaaucuuuuagcacuuuaauuuuuuaauuguagaaggagagaauuaugaauucaagucaaacacauuaaaugguggguuucauccaaaaaaucugauucuuuuacuauguacuguauuaguggauuuauaauauuagugggaggaaguauaaaagauauggaaaaagauauucugguuauguucgugcuaaaauguguguauuagaauuaccaggggaaagaaaaauauaaaagcugcaauagguuuuucuauuuuuuaauaccuaacauuuguuauuuuaaaagcaauaaaauccccuaaagaaauauucguaaucaauaagaacacaaaauauggaauauauuaacugaguuauaaaaauguuuguaguauagcacagaaugaaaaacacagcaagguauguacgguuuaaaguguaaucaauuuugagguuguauacaaggauauaaaugauaaauacaaguaguagcauuuuuaguaaaggcuguuacaaaauacuguauuuauggccuauuccauucuuuuuauagcucauuaauguagaaaacaaacacaguguauccaucuucucagacgguuuaaaauucccuuaaaugauguuuuuaaauguaaauaacugagcucauuugaucugguucuuccuuaagccaauguuagcaugaauggccauauuuaccaccccgggguuccuuuucagacuccggaaagaaaaagcgaugauaaugacguauuucccucccuuccacaaaacagggccagguguaacacacuaagaacaaauggcuuggcagccuacucuccucucucgaagcuccaugcccaccuugcuguugcaccccccaccccaaggaaagccuucccaccuuuggaagcugcauuaauuauuccaggccacaagggugccguugaguuacugguucacugcacuggcuggcaggaaagaguuuuaaugcaggcuccaaaggugcuuaauuuccugugguccuuaugaauaugcauacaguaugugcucagcaaucuagcaguucaaacuagacagcugguucugguggugaggguuuuuuaaauuuauuuuuuauuuauuuauuuuuucucuccccuuuccuuggacaagcccuuucugaauaagcugaaucuguaguauaauuucauuaacucauuuccaguauuuaauuugguuuugauauuuccaucauggccccuuuucuccuuugauuuugucauucuguagaaguugauaaucuguauuaugaucaacaaggcauauugccaugacuguaggaaucaccaauuuagauauccaggcuuccuaaaauauaaguaagucagauuuagcauuacuguuuuccugaauguaggaguauuuggaaaaggaaaaaaaaauaaacauacaucuuggaaagcagagaaagguguuuuguuuucuuucuguuuggauuaacauauucuccaucacuguguaacuucauccaauacguauugaauaccuacuaugugucuggcaccacuucagacaguaaggauauggauaugaauuuguaucagucaagccuuccaggaucuuauuaucuagagagaaagauuaaaacauaugcaaauaauuuugauagaagcaaagaccuaacucagccugagaggagguuggguuuagagaaugcuuucauuguaauguuuuaaagcuuuuuauuuauaacuauaguuuauuuggacuuuaugauuuaccaaguaacuuuagaugcaaauaugguaguacugugaagauuaugguuuuugaaugaagucacuuuguggcaugaugguauagaauaagauauuuucauagugaaaauggagauaagacaugucccauucccuagaauagacugucacugcucucguugccuccaaggaggaaacuguuauaggaaugauugacauggagguucaucuguagaauauggacagcccucuacaaauugggaacaagggccaggacacgaaauauagugacagccucuggccugggagucuagacaguggucaaaggcaggauucauggaguuuuccaagauaagauucaagacccaaacuaugaaugaaagccaggcugaggcuggcaccaaguagaggccuccaauaauguugacccagcggggcugcauuguucacugcccccuccugggaaggaggaaccaaugacaauggagcaucuaagagacaagagaaagggaguguaaaggugaggauuccauggcuuuacacuccagaaacucaggcuagcuuguucucacugaagcagucauaccuucucgaaggcaacuagguggauuacagaauugugcuggguccuauggagugucagaaauagugaagcuucuggagcuucacuguccaauaugguagccacgugugacuauuaaaauguaaauuaauuaaaauuaaaaguucaauugcucugaaauagcagccacauuucaaaucuucaguagccagaugugguuauuggcuaccauauuggguagcaccgauauagaacauuucuaccauaguagaaugcucuuuuggauacaucugcuuuaaagcauuaguccccaaagugugaaggaugaaccacuuggguuccgagaggaaacauuauaacuucuguuuauccauuaaacucuuucauuuauuauuaaacaucucaacacauuuauuggguggcagguacuguuuuaaguguuuugcauauauuuacauguacuguccuuucaaauauucuuugaaauaggacuauuguuguccauauuucacagaugaggaaagagaugugcuaagaaaagagguggcagaguagggauuccagcucaguagccacuuucagggucccguacuuuucaauguaagcauauuggcucucaauuuaaaaauguuauuuuuuacagauaguacacagaugcacugacacagguacccucuccaguccucugauggucaggaauugugugcaguaugcaguacauuccaaagucaggcuggccauuuccccagggagaggguccauguuggaaccuuugcuccuuguggacuuuagcuuugaaauguauuguaguuuugcaugugugcuuaguuggauggauugagacaucagauuauguggucugaacuaaagcaaccgucacagaaugaacaagagacuuacaaacauuugugcaaaaagaucaguguuuggauauaguucuuagaauagcaaauaguaagaaaagagcaggauugguacuucaccuacuccuaauaaaagcccuucaucuugugcaaaguaaacacaaucacaguuugaucagaaguggucaauggaaaaacaaaaaucuaaauuagcaaagagaaauuugaaauugcaugcauuauuuuuaaagaugaacauugcuuuaaccuauaccauuccuggagguaguagcuaauagaaugauccaaguuuauaauuuguaaauaaguagacaucuuuugaggcguaugcccuuaauuuuucuaacugaugaaagcguacuuccaucaacucaagacaguucaaagcagcuuggagccucuuggauuuuaaaaagacucuguggccucugucucucuugguuuucagugcucagcugaggucuacucuguuuauccucugccuacuagaaggauauccuuucaauagaggugaaaauccugaaauaaaagguuucauaaauggggaaaaaagucauugauugaaagagucauggcauagaugcugaaguuuugaugggaacuuugcaggauguucguuuguuuaucauuagcccugggagagucaucccucaccucccaccaccccuuaauuuaaagggauuuaaaauauuuucaaguacauccugauaucagcacgugguacacugagccuaguugauggaauugugaaaaaaaaaaagaauguuuucccaacaauuuggcuguauuugccagaacuguuucaagaaugcuaugacuuuugcucagggcaagggaagugugugugugugugugugugugugugugugugugugugugcgcgcgccugcauguguacuguggaugugauaagagcuguguuugugaaaacugugaagacauaacacauaucuaugaaccuuuucuauuaaucuucuuggggcuggagcuuuaaaauaaaauaaauaacuuuucugcagagagagaaccuuuccuuacccaaagauuucguaacuuucucacauccuugguuaaggcugagcugccuagcugucugcauuucugauagguuuugcuuucauacacauuucaaggacuuaagaaaucuguuucuaaagaauaacuuagaaugugcuuguuauggucccaccuauucuggggaauagguggauauuauacauuuauuuagguggaauggugggucagauggcuucaugucuuuuuacaucacaguuccacagcccucauuagugaagcagagguugaaggaggucacuugcuuuuuaucccaaugucaaauaacuccauaauuuuuuuuauuauuuuuugagacagagucuugcucuuuuggccaggcuagagugcaguggcgcgaucuuggcucacugcaaccucugucgauucuccuuccucggccuccguaguagucaggacuacaggcaugcaccaccauagcuggcuaauuuuuguauuuuuaguuagacaccagguuucaccauguuagccaugcuggccucgaacuccucacuucaggugaucugacugccuuggccuccgaaagugcugggaugacaggcgugagcugccuugccuagccaaauaacuccauuauuuaagaaaaauuaaccaguauuuauugaauacuuacugggcccugugcuaagugcuuugcaugugauuucuaauuuccugaccauucuaugaaguggcuacuauaauuauccugauuucccaggcagagaaacugaggcuuagagaguugaaguaaucaacuggguguuaaaaagcugguaaguggcagagcacuuauuggcgcuaagacuguuucucaggaccuuguuguacgagagucaacgauaagacgcagaacguauguuucauuuuucuugggaaggaucuaucucacucaucugccuuccugugucuagcaagagggccaggcacauaaaauacacaugguacaaucuguuaaaaggcaugaaaaagaaacagucauucauaucuguucguagaagugggcgucaagauuuuggggcacugagaucuaugcauguugugggcccacuuuaagaaaaggagucaaacauuuaguguggaauacuggaaggggucccuagacaugaagggccucuucaaccuaccuuuuguuggcuucaagguuaugccauauuuugcaaagucaaguuggagauggcucucgauaugcaugaguguguuagacugcuuuucuucuauuuuuuaaaaaugcacccaaauguaaaagauacuuuuaccuuuuugauuugauguugaaggucauuugaaaaauacucugucuuuauucuuugaaauggauuuacucucaagaaaguugcaugucacuuuacuuggaagagacgggucucagugaggugugccuccgcuuucaugaaaagucucccgucugcagaagcauuggcugacauggaagauuuuuuuuuuuuuuaauacuuuucuuuuugccggcaucugcguagaauuuuuuuuuuuuuuuuugguaguuucuuaauggucuuuagcaaaggaaguaagugacacugaucggugaaggcagacaguaagauuuauaauguauuugugcuagcugauugccaacagaaccggccuuucccaguggugcuguacgcagacucggaaaaucaauagggauuaaccuuugacccccuucacauacuuauacugugggcugcaucgcuuaccaauauuucaucuguuucacuuagcugcuguuacuuacucaauaauguguggccaaucucacaagauacuaauucuuuuuuucaaaugcagcaucgcuugaagcugugauaaaauaucacaccuuuggaaaucaaggcucuucuuguuuauuuauuuaacucacauuaauuagccuuaauuuaaaaaaaaugagaagagccagcaucaugaugcaagcauugacuuugcucacaaaaacaucuuguggucaacaguggggcuuagggggcagguuuuguggcugugacagaacacguggccccuagugugucuguugaaagaugggccccuuucaggaaaauggcuuaccuuacuuuuuagacauaauuuuuguuuucuguuaaagggucaguuauagauaaguaugcucccuugcaaugaaaugaacccacuuuaucaauuuugaaggaaucaaaauuaacuugaauacauugucuuuuugcauauguauguagugcuuuguauaaacauaugaauuuguaggagcugcucuuaaugauuauuacugcauaggcuggaauagaagcaaaauuugcaguaauacuuuuguaccuuucucuuuaggccuuggcauauauuaaaguacuauacauuugucuuaaaaauugaaauuguagauuauuuucaucuaagacccuuuuguucacagauuuuuuuuuccaaguauaccuauuccccagaguuuacuuacaguuugcuauugauccagcagcugguauuugaauuggucgauauacucuguaacuuguuuaagauacccuaccugagcuauuaguuuaaauaauguauucauaaauugauuaaucauuacaguaagacuuauuagcugcauuuauaucugcguguuauccacaauugacuuauagucuaauaaucacguauacuuaagcagaaguuggguuuuacguuacaauuuaauaauuaucaagguggcaaacgguaguauuuguguguagaaguugaguggauguggggcuuuaaaggcaggagucucuaagcagguugcuaauuuuacuuuuccuagauaaaauaauucucucucccaaaaugaaauacaggaaguggaccaaauugugucagccugaaagaagugauugaguuugcggaagcuguccugaagucgagguucuggaagaugggugggguggggggaagcgaaugugaagugccauugcauuugucuccauuucugucccaguuacaucaaggcugggaggaggucuuuccacugguuuuccgggcuguuuguguacuacacagccuguguaccuggcaaggcacgcucugcucugcccugccuucugaugagcugacuaacaccuuauagaugagguucccuuagaaccaaagaugccccaugaaacucccuaggaugaauguuggaaguccuuccaacugggauucccagccggaaaggaaacaguucaucugacuacaggguuuagguuuacauguacuuuaaaaaaaaaaauuaauaaaguuuauuuuuacaguaauuuuaaguucacagcaaaacugagugggaaguguagaguuucauauacucccuguccucacacaugcacagccuccuccagcuaugcacauuuucaaugaaacuacauguucauugaaaaugaucuuuugggugguugauguucgauuuuggcucuguguugggccugcccagugagguccuuuugacucccuaaggaacccuguuuuggguuucuuuugagguugaagauauuucagacucuuucccccucaacuuccauaggaaccaaacucucuuucuuccucccguuugguuggaaaguuauuuugccucacugcgugauuuuucuacugcaccaacuccccuuucaaacguuauuccacaacauacuaaauuaauguauacuguguucuuuggguaauggggaggggagccugucucacagcacgcauuuguucagcucuguguugaaagagcacugcccgccgcgugaaggacaucugcucacaagugagcaauugugcuucugauuuggggcagcaccuuugcuugaacgcuggcuccagaugaaagaacagauugccgcggagccgcuuuuccaaggaucccucuccccagcauggggcuucauacauuauugagagcaaaccuacuuuccaccgccacuccuggaugcacuuauuuugcgagccuuauucagaaugucagcauggaucacuuggcgacaaaggccuaaagggcaagccaggaagcuuccauggauacguuauuuaugguguuuaauuauuauuguacagauuuauuaaaugacucuguuaccuaggaguccauguaguugcugaaaagaguuugcuaacuuugaaucguagauguuuuaucugaaaacaaaauuuccuugugaaugcuguuaccauauuccuggugucuaugugaggggguguguggugguaugccgguaaguguugaacaaccugcucuguuggcgggaacuaggggaaacaaacccuguuuuguaguauuugcugauuacugugguguaaauacucacaccuuggcugauuucaaguugcagcuuggaacuuggaguuagaaagagauguguagucccauaccauuuuauguauguaaaguauuugcacuaugccgacuaauagacauaaauaaccucaugagcauagauaauagucacaucuacuaagauuauucagaaguauugagcuuugaguauguuuuaccuuuuuaauauagcuuauugaaucauacauuuaucuacuuuaauacuuaauaaugagugugcccaacaacuaggucuuaaaguuccugauaguuuagcagugugcucucuuaagccagucggaccugguuguuguacacuacuggguguguuuaauugacuuccaguuuuguuuuguuuuguuuuguuuuguuuuguuuugaaacagucucacucugucgcccaggcuggaguguaguggugugaucuccgcucacugcagccucugccuccuggguuuaaggaauucucugccuuagccucccgcguagcugggauuacaggugcaugccaccaugcccagcugauuuuuguauuuucaguugagauaaggguuuacugucuuggccaggcuggucuugaacuccugacuucgugauccacucgccucggccucccaaagugcugggauuacaggcaugagccaccgcccccgaccauugucugucagguuuaaauugcaccuuggguucgggugaaguugaugaucuauuccuaaugcaggcucauuccuaacagggcaucccugcacaauuuuccgcuggggugugaugagcugcuucgcauccugcuaaguguccucgacagcgagcagacacauguacccugcuugguacaugccagaugauucuguuguagugauauuaaggacaacaguauuuugccagaagcuauaacgagaugauucuauaacaacagcauggugacaucagacuauguuuugcaauuuucuuuaauauuuaugcuggauaaauaauuuaucuuuuuucucaguuuuuuuucccuuuucuuuuuuuuucuccccaucuugaacauguugcuguagacaggugcuagguuucccugaaugacuaaagcagagauuugguuauuuuccucccagaaaaaguagaugcaucagcagaguugagccccugggcauuauuuccccaauuccguaucccaucuacuaauacaaacuaaugagaucuauuaaggaugaguccacaaguuugaagggagucucuuacuaauguuccgucuuugcaugguguuacaacagcgggaccauuuuacacugaggguuugcgagaggcauggcuccccuguuauguauuugggacuuacugcagaugcuuccucugguucaggguguugaggcuucgugcuguuaauauuggaaggugggucauuuguacugggcaucuguccuguaucuuggagauguuuaguaacaucccugaccucuagccauuagauaccaucucucccaguagggauaauaaaaacaugucuccagauguuggcaaaugucuggccuucuggggaguaaaauggccccugguuggaaacuaguguuccagagcuacauucuuagcugcuuacugcaucauuguuuuuagcccuccuuuucucuggcuuccaggaaccaccaaucccccaacacuaggauagggcauaaggcaaccuuaugucaccaaauuaauguccgccuaggcaagcuggacugcagaaagaaaagcaguauuucuacccuaggaucauuaucccaccuuccccaagcuucgaaagagguacaggaguccucagaaauggggcuucuaaaauaaguggaacugggaccucuucucucucaggcuguuacuuguugugguuccagccuauuuucugagcuguggagcagggagggaucucacaggaaacuugguaauguagauuuuggaggacuugaaagguuccugcuaccuuuggcuggggauggagggaacauggaagaugggucuuuguuuagaggaagcucuuuauccugguacgcuggaaguuggcauagucuuagcaguuaguccagaugugaauuucaggauuauucugugagucuuccaaguccugucucagcagugaaauaggcucaguguagcuuaugucuagguggcugaguucauuuucuagucuagguaaagggcaccuccuguaauugaauuguguaaaaccugcacagugguacaccugagcccuuuuuuaggacccaagagugcugagauuggcucuuccugagauucccucuuuaaggauaagacuuucugauuuuucaacuggauuuaccauuguggcaucugcacaugagcagacugacugcuuuuuggcccuaccuggagccuggguccucagguagcugacccgagagaccguggagcugcuugugauauacaaugucagugcucugagcucauuaggcgucaucugagacaguggcuguaggggaggggagguaggcucugagucaagcagaccuggaauuuucuuuaugggccauuaggaacugugugacgcuggggcaucugacuucaccuuucugagucuuaguuuccuuaccuguugaauaggucuaaugauaucauuauggcagaucagugggacgauugagucaaauaacaugcccaaugccuguuucucagaguaggcuuucagugggccacaucuguugucacuauuauuuuguucuuucugccauuugggaugugcuuucugauaauggcacuaggcugccuuguugccuccugcauguagaacacagaacuucgcagucucugcagagugucuaaauccugcucugggccagcccuuucagaaacacuucaggagaucaauaguuaucugcuuaccuuucuagcugagaugagauuuuaugcuuguuacuagcagaucaauagugaaagcagguucuguuaaguuuuuuauaggagucauuaaucucccucagccucaguuucccuaucugugaagugagucuaaccaggaugauaaugaagaguuaggucaagugagguuggcagccagacacccaccaccagcuguaacauaagaacagauguucucuccagacccccaggucagcugaggucgcucugcuuggaauaaugaacugccacauugaggauuuuuuuccucucuuuacuuggccaaauauccgaguguggaagcucucacugugaaccugcuaacauacauuucagugucuacaaaaugucuuuugagagaaaacagcagggacauucgugagcucuuuuuuuuuucuaaccacuuucccagugagacuucaguuuucauucuccccuuagcagcuuucaaauauguacguaacacaaauguuacauguuugagcauuuaaacugaauuuggacagggcuucuauuuccagaaccuucuaacucuauuucuuugugaccugauagucuugcucuccaggguaaaagaagaggauggaaauggcuguggggcgccugagcugggcccuggcaugauggcaagaugccguucuggguucacugggauggcucaaggggaguuuggaaacccuccuaacaugucaucugaaaucugggaccacaguuccggcuggaacacuugucacuaaagcugcugauaagcaaaggguguaucacugguauggguaacaguugugggaggaggaggggucugacagauagccggaugauuuuaauguuuauauuccacugggguaagcucuaacaaagacccaucauuucccagauaaccaauucuuuuaaaagaacaucuguugaaacuggcaauuuacauucuucuuaaaauacggagcgacauaauuaacccucuggggagacuaauauuaguuuauuagagacaauuucuaguucuguuuauuuuuaacacuaaacgauuuguucagauuggggaaaaaauuuuuuuuuuuuuuuugguugugguggcguuggcuuuuacuugggguugaccuuuccuuaucaaggacguacaaggugaauagcugggugauaauauauggucccaugaucaucaaccaagcaccaacggaagccuuuuggaagugcacaguauuguuuaacacacaaauaacucagcguuuaguaacuuucagguacaaucagucuauuuuaaagggaccucauguguuauucauguaugugcacauguguuuaugcaguuaccuuugucuucauugauuuggacuccuuuggugcucguaauuggugaaauucucuugugaucauuguuguaguucccgcaaaucuauuuacgguuuucacaaggaggucacgaacaugcguuguuuucaaugcugggcuaguuucagacuucuggcuuguugugggacggaggagaaagaagacagggcauuuugauguggcccagagaccaaaugaaacaaacgauccucugauugcucagauguccucuuugacuuggaaagcacccacgugaauguugaaccauuuggcccucaguucuccguccugcagcaaacugcauugacuccuguuuucuacacaguggucuucagcuacaccuuaccaagcaccccuuacccagcaaacguggcuucucuuccccaggcagagcaguccguuacuuagacuaggaaauggcuccgagaagcucacccaucaccauuugcucuacugcaaaacaggacucauuagcaggagcucauaaaaugaaacuggcagugagcucauauggaagaggcaucacgggcaacucggcuuggcucaccagccccugagcugcccccgagugaccgcuccagccuucuuuccuuccaccucucccucuuggccaacuucaugcuucagccaaagugaacugagcucaccaggcugagucaucugugccagcugugcccucuccccgaggcugccugccaugcucgugcuuucuugucuauuggcaaaaggcucuccauccuucaaaauccagcucuuggccucauaucuuccacaaagccuucccagaccuuuacucaccugggccauuaaucaccuucccucucagucagcugcuacaccaugagugcuuuuguaucgugacugucugguuacaaggucaucuuuuccccuggaugagacgccccuuggggaaaggaccaaguuuuauucccuguuuaaccuuggccugacaaccuaauaggugcucagugaacaguucuugaauuuaauucucucccuuuccccacacugauggguauuuaagcuccagugguacucgauguguuguuuucuuuguucuuuuuuuugagacaggguuuugcugucacccaggcuggagugcaguggcagagucucugugcacugcagccuccgccucccagguucaagugauccuccuaccucagccuccugaguagcugggacuacaguugugcgcuaccacaccuggcuaccgugucuuguuuucaaugcaguauauaagagggugcauuguguaccugugggagugauuacagaaucccaucaaaaugggaaucacugacugaaaacuggaguuuauuuguaagcugggagaugggagcugaauuugaaaccccaggagaaaauagcauauaaagucauuuuaaauaacuaucauuugcagaggaggggggcacagaugccuccaguggcccaagacuccccuuuacacauugccguucccuugccuucuacuccucuuuucauuacccuuaucaagauucugcagcccagggugcugcuuguugauggacaucuucaccugacuuucucccugguccaggugcauuuuaagcauggaaggugacacuugccauucucaauggacaaagggagugggggugugggggugugcuuugggguuagucucuggguuuucgaaacuuagcauucucagauucccagccaacugguuucacaugacaaguaaaugagcaaccuggaagaugaguggcguuuccacacacagggaagcagauaguuccauuaggugacagugugugcacaguuuauggaggaugaagcgggaaaccugagccacaaggcaguagagguuggacgagacacucauuccgaaggcggguguguaugugcaaacuguauaauuuuuuucuucuuuucuaucugcuagcaaaguggguaaguugacccaugacaucguccacuggagggaccacauuugugacucuagcaauuaagccucccuucucaucuguggauaaaacugaccucccagugugcuggagucaaacauauucagcauccaauccacauuggacuguuugcauguaacguacagaacacucauucaucuacaucuaggaccauaacagcgagcaggagacagucccugacccuggggacuaagcccaggaccugccacuaggagauauucauggaaucacuguuucuccuccuuuucaaagaagacugaauuuaugaugaaacuuucuucguauauuggcuuugagaaauucuguuuuggugcuuaugugcucuggauaauucucaaugacuuucaaaguuaugauucagggaguaauugguucugagagaauaugcauaaucacaucaagguguguuuguuuuccaccauuuguagccuuuugacaaauuucugggggccucaugccugcuaggccgaauacuugugucccuugagccuggagacggcaaguacccagugugcaugcaugcacucccaaaguccuuuauucacgacagacaucacuaaucaaucagucaugcuuagcauacuacuccaaguagucauuacuaaucaucucuagucagcaugggagauacucuuuaccaucccgguaaagugacguuuugaugaaaacagcauggaucuuccugcagagaacagacuagcccccuguacagcacacaacucggggaauuuuagguuuggugauuuacugcuguuggagccuggacuucuuccugggagaaggcucgaaaaacuucaugucaguuacuuaauggaauaauacauguuuccugcuuccauugucuuccuggaccugacacucacucuuuaaccauaagcagaagacacauacacaaauguccuauguuaagaaucuuuauuuaagacagguggcuagcauuauuuggguccagaagcuucccuggaaagaaaggauucacugcaagaucgacaggcuuacccaguucauuuaggcguggcuugauuuaugcacacaaagcuuugggaacauaucagucacaucaagcuagguccaccugugugaguaacuaacguguuuauuuaugauuuucuuuaacagcacagaagagcaauugcauuuggucauucuaguaucaacugaguucuuuauaaaauaucuuugggguguuuaaggagaauuauucuuuuuacaaguucugauuaaugacaccgcaaaaaugaaaauaaugagcuaauauguaucuaguacuugcuaugcacuuauauguauagaagcguauaauccacagcacuccuucugaauacguuacguaaauggaacccucgcaacagucuuacccccauuguagagaugagaaaacugaggcauacagaagagauggaacuaggccaagagcauagagguggaauuguugugugagccuguagaguccguguucuuacccacugcaugaugucugaucaucgucaauuuucuuuccauuuggauagaugaaugguaauacuucccuacuagguagagcaaugauuccagaaguuuauaauaauuggaaaguguauuagucgauucucacacugcuauaaagacauuccugagacugggaaauuuauaaagaagggagguuuaguuggcucgugguucugcagacuguauaggcuucugccucucgggaggccucaggaaacuuacaguuauggcagaaggugaaggggaagcagguaaugucuucacauggcuggcaguggaggaagagagaaaguagggaggugcuagaugcuuuuaaacaaacagaucucaggagaacucuuucacaagacagcacuagggggauggugauuagaaagcaccucaugaucccgucuaguuccugcagagaacagauuagcccccuaugcagcacacaccuuugugaggucccuucuccaacacagggauuacaauucaaccugagacguggguggggacacagagccaaaccacacuggaagguaaaaaaguuggcaaccagaggcuuagaggagguucaaaucucaaagugaugucuuuccuuuugcauuuuggaugguuuaauaaauaagauugauacaaacacaagcauuaagcaaacaaaaggaaauaaaaacggcaacaaauaaaacuucugugcuuuuugaaauucuguuuuuggcaggcaacauuccaaagaucuuuuucauuuaaaguccaggagucuucugugugaaccccacacagguaccuuggaaagacugcaucuccuggauuuugcaugguucuggcuuaauggacaacauaucagucauuuuuugaggaaaauaaauuuaaggcuuggucaucgguccuugagucagcacauugagcguuuugucaauuagcuccuccccccaucuuuaugguauggcuuuuccuguaauuacagucaagauccuauagccggaggaaggccugucaauugaguaagaggcugauguucaucgcacagugacagcccauucggaggguuuuaggccuguccuuagagaggcuuguuauuuccucuuucgguacuuuguugcaacccagcucaccgccaucagaugaguggagguuucuuaugcuguggcgaaacccagggggucaagccccucggacaugacguacugcaaagugaggauguuucauugauuuauauuuuuaaaauuaaaaauaauuauuuaagcugcaucugugugcuuauaagaaaagauauagaaagauuaguaguagacuguuguguucuuuuuuuuuuuuuugagauagacucuugccugucgcccagguugcagugcgguggcaugaucucggcucacugcaacuuuugccuccuagauucaagcgauucuccugccucagccuucugaguagcugggauuacaggcgcccgccaccacacccagcuaauuuuuguauuuuuaguauagacgggguuucaccauguuagccaggcuggucucgaacucuugaccucaggugaucugcccgccuuggccucccaaagugcugggauuacaggcgugagccacugcaccuggccaguaguagacuuuugauaggguuuuuuuucucaagguguagauuuggcuaggaagucauagaaaauggucuuuuuuuuuuuuuuuggagauggagucucacuuugucaccuaggcuggagugcaguggugugaucucagcucacugcaaccuccaccuccuggguucaagugacucucuugccucaaccucccgaguagcugggacuacaggccaacgccacggcaccuggcuaauuuuuguauuuuuaguagagccgggguuucaccauguuggccaggguggucucgaacuccugaccucaaaugauucccugccuccaccucccaaagugcugggauuauaggugugggccacugugcccggccaggaagauggucauguuuuacuuugaaccaaucugugcuugguuuauuuuuuucagugaguguggauuacguuuauaauuuucgguuacuaguuagguaaagaauaaaaauuaauaaacacauuuauaguucucagagauuccuugagagaggaacaucuuuaaacggauaaccacagucuucuaaacaccugaaagggugucuuuugcugaacuauggaguuuuaguuuugcuuuagaauuuuuggaugauuagacuuguacuucuuuuaggcuauuuuuccaccugguacuauuuggcuuuacugacugcccucauuccccauacaccaccuuguuuuguucagauuccccuaaaucuucauucucgucccaccuccccaucacuccugacuacuugaaacacgacuucuguccucagaaggcagcaguguucccuccucccguucauuuuucauuuucccguugcuuaaaaaaaucaagcauauguuugcagucaucacugauguucugccuccucuucuaaaguuauagaugagugccaaguuggcagagcauguagaaagaucacugcagauguccuugucguguugaccuuauuggagaauuuccuaucugugaugaccuguaaauggaauuuaagggaggaaucaaacguguuagcacgggguuggcauugcguggcuguuuucaauuaacuugaccacuaugauaacaucaaagguguguguaccauucuaugaccauugaaucuccauggacauguuuugggaaauggauuugucccauuacacugcuuucuuuagugcauaagaucuugaagggagggaugcauucuaugcaccccaaguuucugguuuacucgugguuucaggugucccuuuagacaacaucacugacaacucacuauguaaaaccaaacaaauuauuagcuuucuuacuguguguuugcauuugcugugcccagggaaaugggaagugcauugaggaagaggccccaagacauggagaagucacuccaacuuuccggaaaccccuuuugcugugccaugugcauggaaggagaggaaugaaugacuguugaagccagauggccuugcucauugauucucuccuuucccgcccucucaagccauccagaaggagaaugaaaugcucaaaucaagggaguuaacuauggcaaagauguuaguaaugggaaacuuuggaggaaggcaaagucagaaauuauucugcagggagauuuggggauguuggaugcuaaggcccaagccgucuauuguaugccuuuugcuuuggcauaaaacaacagaugaccuucuguuagguguaugucugcucaugcuugagaguggugguguuuggaaagacucaauagcauaugcacaugaggaaguugaccaaaugauuccacagcacauacucauuuuuuugcucugauucuagcuuuuccuccaauuuuauucagaauuuguucuuuucuuaccucacaccauauagaaaaaucaacucaaaguggauuggagacuuaaacauaagaucugacaguguaaaauuaguagaagaaaacaaggaggaaagcuccaugacacuggucugcacaaugaguguuuuuguauaugaaccgaaaaacagguagcaaaagcaaaaauagacaacugggauuacaacaaucuaaaaaauuucuuuacagaaaggaagcaaugaacagagugaagcagcauccuacagaaagagaauauuugcaaaccacacaugugauaagggguuaauauucaaaauguacacacagcguaaaugcaagaaaagaaucugauguaaaaauggcccuuccaacaucuagcauuauuguguguugaauaaauacuuguuugauuaggucuaaucacucuucaugauuggauuuccaaaauguggacucucagcaggacauuacagggacagugguugggucuggagaugucacccuuagcuguuuuucacaaugagagguuguuuuaucauaaauaaaucaauaaaugguagauuauacaccggaguuacugagaauuauaaaaaaauuaaaaaagcccacauuuuaaagggaauuugguauuuuuaacaaagcaucagggggcugggagcaguagcucacgccuguaaugacagcacuuugggaggccgaggugggcggaucacaagaucgggagaucgagaccauccuggcuaacauggugaaaugcugucucuacuaaaaauacaaaaagaaauuagcugugcgugguggcgggcgccuguagucccagcuacuugggaggcugaggcaggagaauggcaugaacaugggagguggagcuugcagugagccgagauugugccacugcacuccagccugggcaacagagcaagacuccaucucaaaaaaaaaaaaaagaaaaaaaagcaucaggguugucaccaugaagcaggaggagaaaaauaaugcuguuagacuucuuaaagcguauuuugugguuuauuuuauugcucuguaaauugcaggcuguaauucauggggcucaggccagugauuucacaguugauagaccaggcacaucucuucccaccccuuccccaccuaggggcaagguuuucaggaagagccccuuuucuaaaccacacauggccugcucacaaaucuuaugauaaaacucuacccacugagaagcacaaggugugaggcuauugaugaggaguugaaggugacagagaccgagaaagugcugcacaccuuuggccuaaaggguaaugagcaacacacaaggauugggagauguucauggcaagaaaaauucagaagggacauuguuguuucacuaauucuguaaaggagagcagcggcauuuacuuaggccgauuccccauucucucuuucuguuuuuaaacagagacagaucuugcucuguugcccaggcuggagugcaguggcaugauggcaugaucauaguucacuauaaucucgaacuccugguuucaaguagucuuccugccuuggccucccaaaaugcuaggaauacaggcaggagccacuguuacuggucuguuuuuuuuccuuaaauacauaggcaacuuccucgauugucucuccuuuauuggcauugagagauaagcacaauaaugauuguuaagauggaauauuaugaaggcucaaggaauacuucugaaggcuuuuugucuaugaaguacacgagguuucuuaauaguuuggccucuggcaaaaaugguuuuauuguaguuucauccuuguugagucaauaauuaacugaguuugauuaaagcugaauuuuccuaaguaugaaaaccaugugggcccuucucuuuccucgugaugcacggugauagugcguaucuaacacuugaagguguccacgcuggcccuagcucagugagauggcuuugcuuugggggggugagggggcggaggugguggaaaggcagcaagcuacgauguucuuauguguguggccuugcuucugguggugggguggcacacaugcucuguagucuuucuggauggguuuggcccacgggagacccccuggcuguccaccagccccuuugugauagucucauagucuuauuugucuuuuggcuuguaucccaccuguucacuuuuuaccauagcuaaccuuucuaaguggucaggugggacucauggagauuuuccguucuuuggcaacuagcagcgacugcagauuacucaucagcugucuccuugaguccacaaugccgggcgguggacgggcuuccugccuccuggcccagggccccuuugccggcucuuaguguagagcacuaguuguaccaucugguaguuguuugugccugcgacucucuucccuauuaggcuuugacuccuuaaggauaagaaccaugucuuauuuuuuuuaaucuguagcuccaguauccagcccaggacuugacaccagccucugucaaauacauccguggaacgcauuuguaagaaaucgaggccaaggcacuggaagucccauugucucuggaugcugagaccuugaauuucaugccauggaccccucccuuacauuccgucuuuaaugugcuauaaauagacauuccuggccuugccuaaauaggauuaaguaguaccaaaugguccuuaccguucugaggccucacugagacucauuuugaaucuuuaaagaaagcaguagagggauggagaagaagugggucaaaaccugguuucugccugugggaaaauacaaaacaacacaacagcaaagcagacuagcaugguucaaagcacacauugagguuuuuggugugccauucuaaugcaugagcucauuuugagccaaggauagcuuuuugguguagaauuuugccaguccuacggucaaugcaguacuaauugugugugugacuuugugcaguggggaaagguggggcuuuaaaauaaaacagaagguaugaauugcuuggcauuugcugugguuccuaagucuccauuccgcuugccaagauuaaauugaauuauucccgcugccauucaguuuuacucugcacaaaauacagccaacauuuuugcauuucuuucuuccuuccuccuuuucuucuuuccuuccuuccuuccuuuuucccuucaucuaucuuuguuccgcuuuuguuuguuuuuuuuuagaucgcugcaugcugccgcguuggguuaaccaugguagcauuuuaccaugagaagccauagcaagaugugccaggugcaugcugcuggaacaccuggcugaggcuccaacagcauuuuccuaugacugaggguaggguagguagaugacucauuacaauuuauaaaauggggggcuuagcuuggguaucaucgugguuauuccaagcagucuuccagcuggacuagcuuuucgggaacacguguguguuugugcuggaagccccaguaauaucauuuaauucgaaagcuuuuuucuaugaugaauuauucaggcaguguuuaccaaaauugucauugaucaguacagacccagagagcauguacaacagcgccugugcugggccugcuaggagucgauauuuucuggcucaaagaaguuccaaaagaauucaaagccagugugucucuuucucuggacggccaagugaugcagguaccacgcuuaggucugcugguguuuagcuugacuuaaaacccagccagggaaauauguuucacuuugcuggggugcagguggaggaggcuauuauucuuaggcauuuaacagugaagaauguugggcagggcagagggucagcugaauggcagggauuccaggucucaguuaaugcccacaaauuucugaacuuugaacauaaauacccucacugcaauacauguuuuucuuucucucucuuucuuucucuuuuuuuuuuuuugaaaaacuuuuuuggagcagcaccugcauguuguaaaaacacaaaauaaaaaaaaaauaaauaaaagcagaccccuugguucagauaucuuuguuuguguaaauguuuuggcauucuuuaugaaaaucuucagauuuucaagagcuuaagaugaccuccucuagccggcugcagcagugucuagguaucugugaauguguaagaaauugagacagccugcaaaauagcucacccagcuuuucuuuaaaguuccaaccuuuuugcuggcucucuuucaaacuguacugcucacuuugggcuguacguuagaaccaccugagaaguucuuuuucuuucuuuuuuuuuuuugagauggagucuuccucugucacccaggcuggagugcaguggugggaucuuggcucacugcaaccucugucuccuggcuucacgccauucuccugccucagccuuccgaguaacuaggauuacaggcauccgccaccaugcuuggguaauuuuuguacuuuuauuagagacagaguuucaccauguuggccaggcuggucucgaacuccugaccugaagugauccacccaccucagccucccaaacugcuggaaucugagaaguuacgugaaacuagcgaugcccugggcuaaugaaaucaggcuccaugguggggaaggauguugcggugggguugggguggcaaugaaaggugaaaaccacuguggucccaccugcccaucgucagauuucgguuccucucagaguuaacguagaagguuucugggggcauggaccugagucuuauccccuuugcaaaaguaagaauuguaucguagccugacucaggguuuuagccaacuucucuggaugcuaaugcuauucucuucuuuauacuugucuuccuucccaggcacacauccacuggagcuuugcagggccuaucugcccuuagcccuccaauauccuuuucauuuucuuuaauaguuuuauugauauauaaugugccuaccauauaauucaucugcuuaagguguacaauucaauggcuuuuaguguauucagaguuugcauccaccaucacaaucaguuuuagaacauuuucauuaacccaagaaaaugaccccuuagucaucaccccaaauaccuccucucuccaguuccuggcaaccacuaaccaaucuacuugcuguuucuauggauuuaccuauucugcguaccucauauaaauagagugauauguuagucgucucuugugucugguuucuuccucuuagcaucauguuuugaaaguuuaucccugcgacagcaucuaccaguucaucauuucuuuuuguggcuaaguaauacgccauuguauggauauaccacauuuuguguauccauucauuaguucauggauuuugugucuauuaugaauaaugcugccaugagcaucuguguuguccacaaguuucagcauggacuucuguuuucauuccaauauccuuugaugacaugucuuggcagugaugucuaugacacugggcaagugucuuaaaauguugugcaucagaaaaaagucaucauugccaaggccagcagaucucgaaaagggggcugggauacguuggugauuuuuuucaugcucuacuuacaguaugacucguaacuguuaauggcugagcuccuccuuaggugaagaaggaaggcaauggcguuuucuauucugggccucccugcuuccagcgauagcaaggagcgaaaugagaugcugucuaagaaaggaaggugcugcgaucuuugauuacuacacagccucggcaguguuuguaugauuaaugaguccauguuucagacguucccauuuaauguauuugagccuucuaacaacauugccuuucauauguugcugacuguuuuugagauuuaugaggccuaacucgcaagcgaugugugucuggauuaagagaaccugagaaucucuauuuaugucugaccccaggaaauucccuuuaagcugcuuaucagaggugcaugcugagagcaugaugggaagauggagucuuccauccgcugguaaaaucuggaaucugcucucauuucauuuucacugaacugaaaauaagguaacagacccucaggucuaccuauaaguaccuuccaacuguuccacuuuuguaaauuuaguucagauaauacauaugcugaaauuccuauaucccccccauacuccagaucuucaguguggaauuuaaauauaauuccuuauuguaaaaaaaaaaaauuuuuuuuugaucaaggugauuuugauaaacuaaaugcaucuuuaauuuuacucacagcaaagcgauucuuuauuuucucucuaaaagcauaauugaugugccaugaucuuugucuuugcauuuuuaaaacugaaagaacauuuccacaccauuagaaauaagauuucuucuuaaaaauauucacaaggugcaaacacuuacauguguauaugcaugauuucaccaccagggggcauugugguuugacuguccaguuaaagagccuguguucuaucaguuuacccagaaacuagaaggccugcgaguauuucugauuccuuccaagaaggauucauaucuggaagagaacagaugucgacucuuuuuccucucuagcaaacaguaguguugucaaauuugcuaaacuuagccaguugaagauuaacaugcaauauauaauaugcaugcgacuaaguguacaauaaauaguaaaucacauuuuuaugcuuucucugaacuuggaagcugcaaguuauguuuuuuuuauucccugggugugaugaaauaaauaacauucaaauacaucuuaaagaugucagucagggggaaaaaagugcuuggcaacuguguuugauagauuucuuuuaugauuaauucuccuauuaaguuuuaaugacuucaaagauacaaagcuagaaacuacaaaacuaggcaugguuaauaaauaacugaaauaccagguguauagaaaugcaucuguggaaaaaugaaaucauguauucucuaggauauauuaggaaauggcucuuuggcaagucuagaggguaaaguaucccugaagggggaaaagguuuaaaaacaguaaacuaaagaagauuguuuuucugaaagaaauucccaggagaaagguacuuucugagauucacauauguagauuacauuguuaugaaccaacauuuauaagcaagcuugaucucucagaaugcguuugucuaucucagauuuucaagaauccucauacaaauuguccaggguuuccaccucgcaguuuucuuccaggguugcuauggcauggaaaguacauugcuauuuuguuauguaaaugcucaacagacuggcucauuccagaagugggcgucgugaugccagugucuucguaauacuaucuuucuuuccccuuuagcacccagaacuuaugaaauaugacucgguuuauccugaacacaucucugugcaucggggaggaugggagaauuaauuccaguuucucaauugcaaaagugaggcuggucauggggcuuggaaccacgccacggacgcaugaagccuccccguuuacaugccaaauccagagcuuaugcauccgugcucagggcucucugugguaggcaacagcuggauuauuuacuuucuagaauaucucgaguucuuaaucugagcaguuucgaaaccaaacccacauuaauuaauauaaauaaugacugggaaacguugcaggacuccccggaaaagaauguauaaauugauguguuuuuguauaugcuuauguauaugccuuugugcacgaaaggagauaaaugguguauuucacacaguuccuucuccuccucuaagggauauuauuguuccugaauuuuucugagccgccgaagcacaauaggguuuagagcguucacaccaggcagcccccacucuucagaacuucaaaucuaaagaucuuuuaaauacacagaacuuacuuuugaaagcuguggcccaucccaaaugaauucuaaucgucagccucuagaaugccuggagugagaaaacagaauauuguucuuuucuguuuauauuauuucauacugaguuaauacacuugccaagacuccgaggcagcuucuggcuugacaaugccuucuuuaacuagccuaguuucuagaauaaaguucggguccaccaggcccucugaguggggcucaggacacucugagauggaagagacuggagaaagccaaucuguuucucccugaaaaucaucuuacuuuuuuaacgcuucguaccuagauuuggccugggcagcccagggagacuguucaagcacuggauaccuagacucugcugggcucuagagaagugcugggcuacagcgcccagugcccuaccucuuggggccagccagccucaccaaaaaaucacgcuucuggcuugcuccaaacucaggaaguugcugggaagucuggcuagcaacacccucauucccaguccuggccaugccucucugcucucccuagcacagggagcaugcaggcuuaaggcuggaagaaaccccaagcauuuggccaggaagaggcaacuaguuccagcuggcccacauacuacacuuuaaaaauuacccagaugaucugauucuguagagagaguggguggagaggacuccagggccauggaggaagauucggccuuucucucccuaaucaugagcaaugugauuuggagagagaaggacccgguuggcucugcaaaccgcauuuccuuggcugaacgccagaggagagaaaugauccggcaagaagacacaccauuccccgucagccccuucccgacccuugcaccccuggaucuucugcugaguaucggauuggucugcguccaagagcuccucgcuuggccagcaggggcugccuggagaaggggaggacaggcuucgaguuuuuuggguagugacuucuguggacgugaaaagacugcaccagaaaucggaggcagcccuccaaacauaacuuggccucuucguucucccuguggacacacaggcuguguucuccuggccaagaguccaagcguguuuuuggcgcgugcugacacucuauaucgcuuuugcuucggaaacgaaucuggucagugacuuagccacucuauaaaaaugaagagcagagcucgagugcuuauaacacgucauuuuuacccaagacagagaagaaaaacgaaagagagccugagcauuccuuugacucccuccacccccggaagguauauucagagucuccaagacugccuccgcccacucacauguuuauggcccggugagaccgcauccucccuuucuauaucugucccuuuucuggaugcagggacacagaauccccuaagugggaagagcuuuggaguggaggcuguucaaaguucuguggugauuaauuauuaccuacccaaggucuggucauugcuauacuugaguucuuuucaggcucaagaucucuaccuuuuuguguguuuuuuuuuuuuuuuuuuuuuuuuuuuuuuuuuguacagagucuugcucuguuguccaggcuguagugcaguggaacaaucucuguaugcucccugcaaccucuggcuccagguuuaagugauucuccugccucagccucccaaguagcuggaacuacaggcaccuaccaccacgccuggcuaauuuuuuguauuuuuaguagagacgggauuucaccauguuggccauauuggucuugaacuccugaccucaagugauccucccaccucagcugcccagggugcugggaucacaggcgugagccaccgugcacgaccucagggucccuucuaaccugugcuguugucauaaacccuggaggagaagcaagaucuuucuagcaggagcaacaucaucccaaauaaagugauagacuuugauaguguucuucuauucauucaaccaacagagaacaaaugaaaagaaucaggagucuauugaggagacagaacaugagugauuucugugugcugacuauauuuaaagacaagauuagcaguaauauauaaacguaaauaagaauuuuuuuccccagccaagaaccauagauuggacuucacauucaaaauguaaauugugccuaggaaacaucaaugcuuauuuuaagcaacugacccuugggauaaaaauaaaaagucaaaaggaaacaaacaauguugcugagaagugauagaauauucuaguuuauaucucagucauuuuacagcucuggcauuucuggguaacacuuuagaauacuuccacuccgguugguccauaaaaagcugccuguguuuuuauguuuugaaaauacacgcagagagacccacugcauguccuauuaggcaucuuauccuugaguaagcaggcaugcaacaucagugucacacacauaucacccccauacucgacauucuuugagaaaugccuuggucccgucuccagccagaucagcauugcaccucuuggcaugcguucuuaccuguugaggauuugcuugaauuauaauaugguagaggaggaaacacagucuuacugugccgugugcugagcgcagagccauucucagcauccugccuugauuaauaaggcgugaaagauccuccgaauucgcaccuguucagacaagcuuguccaacccauggcccccgggucgcauguggcccaggacagcuuugaauguggccccauacguauuuguaaacuuucuuagaacaucaggauuuuuaugcacggaccuuuuaugcauggacugugguguuuuuugauuuuugguugcgugcgugugugugugugugugugugugugugugugacggagucuugcucugucacucaggcuggaguguaguggcaugaucuuagcucacugcauccucugccucccagguucaagcaauucuccgugucucaaucucccuaguaguugagauuacaggugcccaccaccaagcuuugcuaauuuuuguauuuuuuuaguagagacaggguuucgccauguuggccgggcuggucuugaacuccugaucucaggugauccuccugccucagccacccaaagugcugggauuauaggcgugagccacugcgcccggccuuuuuuuuuuuuuuuuuuuuuuuuuuuuuuaacgcucaucagcuauuguuaguguuaguguaguuuaugcguggccgaagacaauucuuccuccacuguggcccagggaagcuaaaagauuggacaccuguaaacaaaaacaacacagccaucuagcugcaagacguagcuaauugcucugcagaacaggguuggccagccuggccuugaugucggaguguucucuagaccucacacccagucccuauucuuagguuuuauuucucaaaccagguuuugccugagaaauuacagcaaaugauucagagcacaaugauguugcucauuuuugauaaguaguugaaagcugauggugcccuccauuucaaagcaacagaagaaacgcugguggucauggagaaagaguugggaagcagagcgugaaugccgggaucugcagaucugagcacuaugccugcagccgaugucucuccacagggcugaucugguggcuggggugccccuggucagaaggggugauuacuguuuccucucucuccuuggucucugucaaaccuaccaacucuuuucaggaaugcagauauuuaauuaucuucugcuguuacaucugcaucauguauuggcuggcuguucaaaaguauccucucuaggcaaauaacgagauuucgccagcaggaucucccguuaaaggcgugcauguguggcuuuguagacacguaugugugugugcgugcacaccugccugcccuugcacagugggcacuguuuccagugugcagugaggcccucccuucguguagaacaggacaggacaaugacaaaguuauucaauuaauaauugaagcuugccgggcauggugguucacgccuguaaucccagcccuuugggaggccaaggcaggcagaucaccugaggucagaaauucaagaccagccuggccaacauggcaaaacccugucucuacuaaaaaauacaaaaguuagccgagcgugauggccagcaccuguaguccuagcuacuuagguagcugaggcaggaacucgcuugaacccgggaggcggaggcugcagugagcugaguuugcaccacugcauuccagcauuggugacagagcgagacucagucucaaaaaaaaaaaaauaauauaauaauaauaauaaucgcaccucaauacuccguagccauuuuaccgcaugugacuauuagcugugcuuuugcgguuaucuacgucuguugugucuauacgguggaguauuugcagacgcucugccagugugcaaugcuucccagcccugcauucagggauaccaacuugggugcugaaaagcagcgauggcaggacuauuuacaccacggaaacaggcaaaaacuacugaucaagccuucacuguuuuguuuauauugucuugacuuagaaagugauugcaauguuaauaaugcagauuaaauugaagcguacagugccuauaaaccauuacauuaugaauaguauaaaaaauugaggaagccguguggcucacaaauucagcacuuugggaggccgaggcaggaggaucacuugagccugggaguuggaaaccagcccaggcaacauagugagaccucaucucuuuaaaaaaaaaaaaaaaaagaaagaaaaauuagcuggcaugguggcacaugccuguagucccagcuucuggggaugcugcagcgagccaugauugugccacugcucucuggccugggcaacaaagagagauccugucuccaagucugucugucugucugucugucugucugucugucucucucggaaauauuccuucaguguauuaguaaagaaguuacuuaggagucacuuaugcccuugaagagugagugauguaucaaaauaugucugucuuuauuguuucacuuucauccuucuuuuuuuggagauggagucuugcucuguugaccaugcuagagguggcgcgaucuccacucaccgcaagcuccgccuccugaguucaacugauucuccugccuccgcuucccaaguaccugggauuauagacacccaccaccaugcacagcuaauuuuuguauuuuuaguagagauggaguuucacccuuuugauugguuggccaguauggucucaaacuccugaccucaagugauccaccugccucaccucccaaagugcugggauuacagucgugagccaccgugccggccacuuucaucuuucugauuaacugaaaaguaucaagcaauacuuacauguaacugcacuuucucaucaacugcaaccauaauuuagcuauggauacaagaguugggcacaaauccaugaaagcauugagugagaaucaauuggcucugugggauuuacaauaaagaauguuguuuauuuuuauuuguaaauugugugcuacagauccuucguaucaguaaaauguaugauaaacauauguguguauauucacacacacccuuucauuuuggcaggaguguuuguuaaacauuuaccacagcaguggauucacuuccaucagcugcuaacuuucaaggauguuugaggaugcaugaccugugcaaugcaccugcuucggugccuggcacagagucgcaaagccacaaagauggugcuuguugguuguauguguuguuuccaucugauaucaccauugaggggagcaagaugacaugugccuaccccacguguccagcagcaaagccaccuggcauagugggcugcucagcgugccugguucauacugcguguuuauagucccaggguguuuucagagagcaaaaguccuuuaugauuagcaaauugcagguccuccccuuucugauauuuacagcccuugcaaccgccuguacaaaaaucgggaaaaggcagaagacggcugucauuaauguaaaagcagcugguuaccucccccuccccagcgcacacaucaccuccuaguacaauuagucaccaugucuuuucccuuccgucaagccuuuuagcggaguucacagggaugccuucgguccagacacuaugaccguugacgaaggauuugaaauauuuugagaacucugaaauaaugcacaccagaaacguccagcugaaaacaaaaagggaacaagaugacauuuugcaaucccaugcacguugcaggcacguugaaugugaaggucaguaguacuucagagggcaggccuguugcccccaagccuguugccuaagaaaugcccaggcccuuugaacaaaauggauucgagugauuacagcacguccucacuuacaucucccaauauauuucuuguuauucucguugaguacugcauucagacagagguugccaauaaaguuuauuguaggagcuaagugucaauaucuguaguaccccccgccuagggugcugcuaauaaaaugccacagauagucugggagaggcaugaaaauuugauggcaaauugauuucagguucaucuugaaauuuguccucagcuggacucgauacuucuggcagacaugggauggcuuuugucagaagggucugcuggaaugagacagagaugucuugaucugaauauuaaauacaacaugcuguuuaugacauuauccguuuacugcuaaaauacccagcuacuucuguuuacacauucuucugcguugaauggguaagauagcaucucauagauccacuuuacauaugaaaagaaguuguaucaaacuugcugggcaucagaaauaaaggguuuuagagacacuggcuucaaacacaaguuauuccauccaagauucuaaacuuagcaaugcaacuugcacuuaauuuuaaaacgcuggaaaaauaaugauaaagauugugugaucaaguauagcagcccugugguguuuccucagaaugguguauuacagaaaaggaaaaagccauauacauggagaagaaacucccgauauuuaauauuaucaauugcugguuccuguaaauuugcauuuauggaucacauuauaaaagcaauuacucuuauggauuguucaugcagaaaugcacuaugaugauaauauacuuuuaaaaguauauuuauuuccagaauucaauuuguaagagguuugagggaaaaauaauacugaguuuugaguguuucugauuuuaaaaauguguugaguagaauuaaacguguucaccaaaacccauuuuaucacuuuaaauuauugggcaauuaauuguauuuacuuagcauugaaugcaugauuagaaauggaauuuuuaaaaaagcaauacucaaguggagugaguucauuuguucauucagcaaauaggacuugaguccccuacuaugugcggagccuuaaaggaugagaaagauuucugggugggacuucaaugagacucauuucgcagguuuucauguuauuauguauaugugguaaauaauuaauuuuuucacaaguacuugcacuagugaugcuaaaauaagcuugacuggcuuguaaaucaaugaagguuacuguugcauugcuuugaaauugaauuuaaaaacagaaacagagcagucccuuugcuuccgaaugcagcccucccauuggaaucacuuuggaagaaucuggaucugcguguuacccagucuuacuuuucaggcagucccaggcaggaaggcccauuagugaaaagagcccugcauaugcugugggucaucacagcugcugcuuugcacauuuaggagauauuuguggaccuuucauuaggacaauuuuuauggcccgagauuaaaaguuaaaguuaaguaguaaacguaaugaacaugugccuuuggagauuccaacugguuuguauuuucauucucuccguuggucauggcccauugaauuuugaugauagcauuaaaacaaaugccucaaaucauuuuuggaaggagacaggauaugaauugacaaauuaauaaaauaaauuauacuucaaagaugcuaaauuaucucuucuauguaaguaggaggcucucuuuucagauguggaauuuguaggagcuugaauauucucaagagaggguaugggcaacauuugauaaaagauguaauuauugggucguaggaaauaaugauugagauaggguauccacugcccuggugggggaaucagugaggcuaggaaucacuggaaaaugacauuccuugagacuccuucaauggguagaguuugcuuuagcuuuucauguaucuuacuguaugaugguugcuuuuggguugaauuccaccuuggguucaauucaacaugaaaguuaaccuuuuggugaaggaaugauccaggggaaauaguaaaauauuagccuguccuccaauacaaauugccugugagucccacugauacuuacaaauauacagaggugguguaaaaggauucugugucaaaacuauuaauauuugagaaauacaauacuuaucagagccuuuguauguaaaugucucauauaccccucuaagaaggggagcgaauaguauuuuccaaacuuacgucaccacuuaccauccaccugcauacuuuacacgucuuggaaucaaccuuacagggaacacuuggucgaaaaacaguguuuucuaaauuuauauuacaguucccacuccccccccccccacuuguaucacuuuguaugacagucuucuugggaacauccauugggaaacucuucccuugcaggugucuguuacaaguccugguucacacaguguugcgaaagaauaguuguaugucacaauuuucuuuauauaguauuuauugagaaaccuauucuguuaauagaaugacucaaaaucagccaaccccauaaauacugcucaagcauuuagaaagacuuucucuauagaggcuucagacgucagaaaaaaacuuagagagugacuuucagauacagcaaccuagucuauguuauagaacauucuaaaaagagcagauuuuaauaucuuuccucccacacuugcuuugacucccuccuuuaguaauuagauaauuauguauaauaagcacauuaauuaugugcaacagcugccauugagugugugcauguacaacugcuugaaaacagcuugugaguucacuauuagguccaugaaauuuuucuccuuggcagguuuucacuauuaguuugcuugacaaaggauagauacauuuuccauguguggagguaaaagcagugcagugagcuaaaaaguuagcaaaggugaagugguccuaaucugcggcccugguacacuuagauaggcaucauugccuuuccucugagcucuuggugcugauaacagcuuccuugaccgauaaguguaccagauuuccuuaccugucccagggcaagauagcaagaguuucuugaugcauuuaaaaaaugcauuuaguguuggcaaaaggcuggcaauuuauuauuaaguggaauaagcaguuuaaaaacaguauguacagggugguuuucuggcuauauaaacacacaggcauugaaaauagauauacauaaauaauguuacuauaauuugucugccucccuucucucagaaaagaccaaugaauuaucuauuaugugccacucacuauuugagugcugggaauacagccccauaaagugaaguuucauauaucagguagcaagauggccauggucuguguuuugagaaucacaggcguuuuugaggcucauggcuauaaucccagcacuuggggaggccgaggcagguggaucaccugaagucaggacaucaagaccagucuggccaguguggcaaaaccccaccucuacuaaaaauacaaaaaaaaauuagcugaaccuggugguucacgccuguaauugcagcuacucaggaggcugaggcaggagaaucacuugaacccgggaggcggagguuacagugaaccgagaucgugucacugcacuccagccuaggcgacagagcgagacccugucucagaaacagaaaauaaaacaaacaaaaaaauacuauuccauagcugacuauuuucugaaaugauuuuguuacuuuucuaaugagaaaaaaauagaucucguguguggagggaauugaagauguaauuucagacucugcguacagcuaagcucaucguaguuacuuaacuaacacuuaaggaauuaaauggcauaucuguguuugagaggcacacugagaugagacaccagcucuuuuuauuuauuucuaaugguuugcuugguguacuggucauuuccccggaagugugcaagaagagguaggugacuugcauguugucuaugaacguuuuuagaaacgucugguggaaccauccgggcaucacauagcuaucucugugcagagccaggccggaugccuaggugagauggaaagcuuccgucagcuuucuugccggccucuccucgcagccgcucccuuccacaccugccuuuucaccugccagacugcgcguugcccguugcccuaggucugcguguucagcacuucugcaacaguuucuucugcaaagguaacuuagcggaggguacagggucuucuuccaauaagucagcaccuucaguuaaaaaaagcaauaacauucuccaaucuuggcagucuggcaagguagaaagacaccugaaggugaacaucuuuggcccaugugaaauuuuguuacguguuguuagguuucauuugucucucagucaaucagucaaucaaucagucucucuccuuccauccccccuugucccccuuuucucuucucuccccuucccugcucccucucuuuaagguuuucucacagauuaagagaguagcaugugcucaucccaauuauugaaaccgugcaaaugaauagcaagaaaaauaguucuuggcgugccccuuucuuuccgcagugcccaggccagaaguaccugcugcccaagaccacagcugacagcgccccgggaguccuucacacucuucucugagcucuuccauccuuaaacagacaucuaugccaaaugcagggaggguuugcuguuggcuuuuacaagaacacuguccuguuaugccugcugcucuuugcuugguuuucccuggacggucacaaacauaccuccaggucaacaguuaaagagagaacccacuucuucuaauaguuguguaauauuccauacuacagauauucuguuauuuaugguagcuagauuucuauucauuuuuaauucccaugcucagagcuuuccagacauuuggaaacauuuuagaaaauugacaucaucucuucaaauaucugaacucagauuuccucugugauguuggaaucuuuaaaauaucaugcauacuuggccuguuucuacaauuuuguuccccagccaucguucuccauuuugcacguguauugucuccuccuauuccucuguacccuucacacgugccugcaggguauauacuuuugcacaggcaaaaguccagcugaaaugauccuuacuuagcauaauuuaaacgcgaggguuuccuaaugcuccuuccauuuaaauaauucaaaaauccguggcaagguaccugaaaacuacuaagagaagagagguguuaauggacacaucauugaggcugaagccaaacugugugauucugucugcaguugagaacuguaagaaaaagaucaagauuaacauuauuauuauugguguuaccucaugucuguaccuuuuuggagacuugggucuguuucccgagaaaucauuuuuccuccuccuugaaaauagugaauuucaagugguuuuaauuuuaacugcauuauuuguuugcuuuauauaguuuuuaaaguuuuaugaaaaagucuuccauguguuuuuuauuuaugaaaucggggcagccauccuucaaauaugaagcagguaucugagaauacuaaaaucuuacagugcauuuuauaggagugugaaugauuuuucugcaauugacauaucaaggagcuuaucaucuauuauuaaguuaccuuuuccugaaacaaaauauuugucagauguaacuugguacccaaaugccuuuucuugcuaaacuaggaacugucacacacacccacccacccaccccuuuauucuugguucucuccuauauuuugacauuugaagcauccacagaaaaguaauagaaugagcaauugaaaaucaccagaacugaaauuauuuccagcuauguuuaaauaugaaugucuuguucgacgcuucgcauauguauuuauggcugugugauaucauuauggcauccuaaugaaugucuacugaauuaugugggauucaacaggggauacaaauggauuugaauucuguaacugucauauugugguccggagaggguggaaacugaaguaucccucugcgucgccacaucugucaaaaguccucagcgcuccccgcaauccaugucugguggaagcgcgagguggugaggauggaaagggcaugcguugacuucauguugggacgggucuuaaacuaaacacaugucacguuauggagcuguuuaccuuggcuuugagguuuauuuccuucuggauuaagagugaugucguuuuauauaacaagaagugaaaaaaaaaaagaaugauguuacacaaccuauuuuuuuuuuuuuuuuuuuuuuuuacucugaauguguaacuuuaaaugaagaaccaggacaccucauccuuuagucuuuucuuuacuagugaguggcagauauguguggaccacagagauggacugaaaagagaaguaacaguccuugguuuguauuccagcccccaccuuccuaugucuuugagcuugguaauuagaugcuuggagcuucaguuuccccaucuguuggaucagaacggcaguaugugcucuccaguauuuucauaagagucacaugaaauauguaccuacagagucuaucacugugcuuuuuaaguuggggcuuaauaugugguaguuguugcuguuuuuguuauuauuauuauuaauguuauuuuuuguuuguuuguuuuuugagauggagucuugcucugucacccaggcugaagugcaguggcgugaucucaacucaccgcagccuccgccuccugggaucaagugauucuccugccucagccucccgaguagcugggacuauaggcaccuggcuaauuuuuguauuuuauauuagagaugggauuucaccauguuggccagguuggucgugaacuccugaccucaagugaucuguccgccucggccucccaaauugcugggauuacagacgugagugaccacgccuggcccauaaauguuaucuuuauauaacauacucacagcucccuuaggaguacuuuuguccauuucuacacaauggaaacuuauaauuuuagccuuagcaacauguauuuacugggcaucuagauuucauuuauuuaagaacuuuuuauugaaugccgauuguucagcagccaccaugcaagguccuggggaaccagugggcagccacacagagaaggucccaauggcaccagaacaaggccagcuuccuaggaggugucuggcuucaagacagggauuuccuuuagcugggugguagagaaauggauugccugugauuucacugugcauaaaaugaccuuucagcccuuaaccugcgacauccacauguguucuuugguacucacggguguuaugguucauagcuguggucuucugaaguauaggaaaaggcagcuuacagaaaaaaacuugcuuguuuacugucuucugagcugauuucucaccuacuggcaaguggauaggucuaguuuuuguuuagcuguuuuucuaauuuaaucuuauacaugagacagcuauagauggauguauagucuuugaaguggggccaguuggcuccgucuauuagcuguguggcuuuugugcaggugacuuguggcccccggccucagggaucucaucucuaaaacgaggcucuugauguuaccugccuuacccagcugugaagauuaaaaggguuuuguguguuaaaggacuugcggagugccuagaacccaaugagggccacagagcuugcuccgauugcuuuccugaaggcaguaagcauguugcucugguaauagucaucuucacggccaucauuuugaucacauuuuggcuuaguuucuuccucuacccucuucccacgucagaccuuuccauggaagguaaaacauguuaacagucuaauguguuuccuucuaauuuuuuucuucauuuauauuauacaucuaugaaauauauauauauauauuacauauggauauauagacauacacagaugcauauuuagggugugcuaugguuagaaaguuugcauccccccaaaauucacagguuaaaauccuaauccucaaggucgugacgguacuacaaagcaggaccuuuaggacaugauaagguccugggggcggaggguacuaauccccaugaauggguuuagugccuuuauaaaacagacccaagagagaccguuauccauuuuaccaugugaggagcccacaagcaggugccaucuaugagccagaguggacccuuacccaacaccacaucuacuggccccuuuaucuugaacuuccagcccccagaacugugagaaauaaauuuguuacucauaagccaccuaaguuauacuauuuugggaucgcagcgugaauggacuaaagguuuuugagauucuuuuuucaguaguuucaccuaauaaaacauggaaucauucuacgcaugcuguucuguauuguaguaugguuuuccacacugagaacauacugugaccaugcagucauuucccagauggaacuuauugagggacauucacuuaguuucgaaagguuucucccuccacucccaucccggccacagauagugaugcaauaacauccuuguucgcauguccagucugaagcuuuuauuccuaugggaugaguucccaggcauaggauugccaggcuggacucuaaauuuugaaaauggauuuuuaucauucugauggauuacggugaagagagccaaagucuugauagaaacacucaacgcagugaauuuuuuagauguaaaaguggaugguacuuaaggauacgcacauuagaaggaguaauuugaccagcccaucacaguauuaauugauuuucaugucucgaagacuucugauuucguuuucgaggcuggaaaggcagguggaaagcccaucaguuuuacacacauauuuugcagacaaguauuagaaaguaacuagccugcuuuuacuaaugguucuguggaagaaacacagcuugaauaaaugucgucuuggaugcucagcacagauuggcaguggaugucaggauugucuggugggaaggcugcugggacucacucuagacugggaguggggugggguggggcagggcaggacggcccuggcugauuaauaauguuuguuaugaagucuaggguacguggggagagcuucaugaaucccugcauuggccaccccuguaccacggccaaugauucacccucccuaaaucccagggccagauauuagaacaucugugaugaggacugauuuucuguucguggccucuggaaguccaguuuuucugagcucaggggagccuugguuguaucuuauaggcaagagacgaauuuacauuuugccaugguguuaacaagcaaaagaagacaaaagagcucaaaauagacaguggcgugcuggggucaggggugcuggucaccagggcgagcaguuaugggugaagggcugaauuugcagggucaaggagauugccuccaggccccuucuggaaacacacucccugagccuuguagaauugaguugauucuguuuaacugcccagugaagaaaugacuuccuugcuuuaaaacauuugacagcugucuuauauaacuuaauucuucauuccaguggcuuuuggagcagccucaaaagucauuuuaucuucuuggcucuuugauauuauuuguaguaauuuauuuaaaguaauuagagacgggaucuugcuguguugcccaggcuggucucuaacuccuggccucaagugauccucccaccucagccucccaaagugcuggaaauaagguaugagccaccaagccuagccuugauauuauuuuuuaauggggguguguggguggguggugauggggauauuccagcagaauaucagaaacagagaugaggaaggcagagagagcucaaagacaaggcucaaguucauauuccaacgccaguaccugccaccugugugaagcugggcuaauuauguguuuagguuuccuccuucguuaaauagaguucuacuuauauuacaggguugucaugcaaguugaugaauuaaauacgcuaauauauauaaauucugaguaaguauuaaccaaagaaauggaacaucaauauugguucccagucuaguucacagguguuaucaagaugguuaccuuucuaagugucuuuuuauuucacuaguuccaaaagaguaucucucaaaauauuagguaguauuuagucaacacuuuaacacauaacuuguuuuuuuuuuuggcauaagaagcccaugugaaaacacaguugacccuaagccuaugaaaaaugacuugugugugggacugggguggcucauaggagaaggaggauauucgucuggauuuuuacugguauguauauauuuuuggguacuggagauggggacagugaguauuugaagcucacagcaggcccauuuugcaaguuuucaggaaacugaaauucagagagauuaaguauuuugccaugaaucacuuuguaguaagugggagagcuguugcaaacccacgucugucuacauccacagccugugcucuuuucauauacaagggaauauggaggagaagggaagugauggaaggcuuuaaaaaaaaaaaaaaaaaacuucagaagcugauuugagauuuauucaucuuugguguacuuucuuuacuaaggcagguuguagacucaugaaaccuagaaggaguugaaaaauaaggguuaggauuaaaaaaaaaaacuagugaaaucaagacaccauuuugcuuaauugaaggcuugcggaacauuaaagcacaacaaaaaccuaauucuuugaguguuucugaggccaagccuuuucccacaaggcacuguguacacgguucuggaagcucuccucuguuugcacaguagucacucauccugcucucgggcucugccugcagucucuuccucugucuccgaugucacucuucucugucuucuucagaagcugucauaugaccuccagauuucucuuugacucccuguauuaccauuagaagacaucuacacugggaaauugcucaguuccuguuuuugauuaauauuuuaucagccgcaagaggaaaugguauucuauagcaacacuaauaaguaauugagcagaugagaugcucuugcuagcuuugguaaaaagucggggcaagguuacaacagaggagcucugaugagacuugggaugauaaagucaagucgaauaucugguaggguuaaaaaucuaacagugggccaggcgcaguggcucacgccuguaaucacggcacuuugggaggccaaggcagguggaucacucgaggucaggaguuugagaccagccuggccaacaugguaaaaucccgucuccacuaaaaauacaaaaauuagccaggcaugguggcaugugccuguaaucccagcuaccugggaggcugaggcaggagaauuguuugaagcugggaggcggagguugcagugagcugagaucgugccacugcccuccagucugggugacagagugaaacccaucccccaaaaaaauaaauaaauaaaaauuaaaaaaccuaacacugguacgagaagaaauuaugcucuaaauccuucuuugagcaguggcuuacagaccuaaauuuaucaaaggugguggcaguaauaguaauaauuaccaucuucauuuaaaggcacguaucuaaaccaaaggaccuaaauaaaauauuaauuuuucauaguguuuaauaugugccaguauauauaaauucaagguaagguagacagcuguaaacuggauccccugcuguacccagcaaaugcugagagcccugcuuccccucuuguauucaaauggcucuauaagagaggaaguaguacagcuaucaguaacaaugccauccgguaauuaccgaaucauaaauguuuggggagcugaaggucacgggcuuaguagcaauucuagucugauguuugauuccuugugaauuuuaaaugcuuguacucucuaucugggugaugguguuuuaguugccaguggacagucugauggaggugggggaagaguuauucuuccauauuuauuuuucuccaccuugggugaaaaaacuucgcuuuucguaaugugguacagugugugcuucuguaaauggaaaugguuucagcacaucacagucaugcuucccuguugaaagaugcuccguuuucccgcauacaugauguccagcacaacgucugauuuaugagagcaugacccugggggccucuggaacagcugcucacacacucccuuuaggaggcccaggcucucaggggaggcccauagugcagcuaggagcuagaguuuuaggaugaagaaauuacagguaagaacacagccccauuuuaagaaauaccagugauuucuguuuuuccuuguucuucuuucccucaguauuuuauuaacaugugcuacuauacaaauacacaauucacuuaggacucuguuucguguggaucacaugggagcuuucauuaaauuguggugauuccaaugugagugguuaucaagucaacaucaaauaacaugaaguguguuuuagucggcaaacaucacuuuguaauucucugauguguuuggguugauucccuucuuucugcucuuuuucucuuuauaaaguaaacauuuuuauugcaaagguacugcuauuguuaguuucuaaaggcacuugucauggugugacuaauauuagaagcagacacagccaugaugagcaauacucuuuuuuuguuuauuuuuguuguuacugcuguaagccacuuucuucucccucuccauuaaaaugcaacuuaauugguaaaguuuaguugacuagagauuucauuuauuuauuuauuuauuuguuuauuuauuuauuuauuuauuuguuuguuugagaugagucuugcucuuuugcccaagcuggagugcaguggcaugaucucggcucacugcagccucugccucccguguccaagugauucuucuaccucagccucccgaguagcugggauuacaguugugcaccaccaggcucugcuaauuuuuauauuuuuaguaaagacgggguuucaccauguuggccaaacuggucucaaacuccugaccucgugauccacccgccucagccucccaaaguacuuggauuaaaggugugagccaccgcgcccagccuguauuuaucuuuuuaaguaacaaaguauuagcauugugauaaauaauauuuaauauauaguaagggaggucaaaguaugaacuauuuugauuuuuuauggguuuuuuuuuuuuuuuuaaagaaugcguugauuuuguuuuucuuucuuuuuuuuuuuuuuuuuugaggcaggccuuaggucuggcacccaggcuggagugcagugacgugaucaaggcucacugcagcuuccaccuccugggcucaagcaaucuucguguuucagccuccugaguagcuggaauuacgggcucaugccaccacacuuggcuacuuguuuaauuuuuugcagacauagggccucacuauguugcccaaacuggccucaaauuccuagcuucaagcgguccuccugccuuggucucuccaagugcugggauuauaggcaugagccacuaugcccagccaaauuuuguuuuucuuuucuuuuuuuuuuuuuuuuuuugaaauggagucuugcccugucccccaggcuggugugcaguggcaugaucucggcucacugcaagcucugccuccuaggcucaugccauuguccucccucagccuccugaguagcugggacugcaggcgccagccaccacgcccggcuaauuuuuuauauuuuuaguagagacgggguuucaccaugcuaaccaggauggucucgaucuccugaccucgugauccaccagccuuggccucccaaagugcugggauuacaggcauuagccaccacacccggcccagauuuucuuauaaagucaaaugggagauacuuguuugcaggaaauaguucuuuugguucuuacuuuuccauaaggauugagucucaaaaugucugguagcauccacugcauuuuguaggggacaauaacaaagaagaugccagcaauaucuucuaucuuuuccaacauuauucaccucucccacccaaggacaauggugggcuggacagagcauucaaugaccgagaaucuaccauaagcuacuagggccacaucuuccccuuucuucucccccagguuugucccauuuguacugacucugacccagguugucaugacuugagacucacuagaaguuucagaaagaugcacacugcuuuaaaaaaaaaaaaaaaaagggcaaggggaggugugagaagaaaguauaauucuuuuucuucuaacgggagauauaaaaaucauauaagcaugauuuaucauuugauuggaacauuguauuuuaugguugcagagcacauguaucauccuaucugcuucugacacccaguaagcagcucuggcuuuuauaauuuugaugaaagagguuuccuaacaguauuucggugugcaugcucacacaccagcccuggucaucagugaacagauucuuccaggucuucauuguagcggaagaaagugagaucagagaucccgaggaagggcuucaguuucaccaguaguggagcuagggaguagcggggcagaagccgcaggaagucagugcaggacgccggaggccacuccuaauugcuucauguguuguugccgugcugaugaccuuggaggcgcugcugguccuggauccuugcgaccuuuucuuccaagaggaaauguggugcugagccccccuuccacuggcugugacaaagaaggaccccucaugugggggccuaauucuagugaauccccaaagguacauguugaaauagggaaaaggcccaggugaggcugucuauguaauagagaagauccauugcaaaaugaaaauaugggguucuagccaggggcagggaacuuaaucucccuuuuccaugggcccaacaccugaaucuagggcaaacaggugucccccagauuggauccucugcucuaggacacauucuuguccuagagcggguugggcaagaggcuuuucucucagucaccagccccaaacccuguggucuugccagcccaggacgugucaagacugcagccuuugcugaccugugaccaucuccaaguccaugcccaggccccuacuaggaguugagggcaacaggggcagugggucucuccugcuuaggaaauuuggguugaggguggcagugaucuugaggggggucugggagggaggagccagccuggccuggucuggccuggcccagugugccagcgagggcaggugcaauggcucacgccuauaaucccagcacuuugggaggccgaggcagguggaucaccugaggucaggaguucaagaccagccugaccaacauggugaaaccccaucucuacuaacaauacaaaauuagcuggguguggugaugcacaccuguaaucccugcuacacaggaagcugaggcaggagaaucgcuugaacccaggaggugagguuguggugagccgagaucaugccauugcacuccagccugggcaaaaagagcgggguaaaaaaacaacaaaaaaaugauguaggaaugaacagaugaacaaccccacacaaccuaaggacgacuuugaaucaauucuucuaagcugguagcagaagccaccuuuccauuugacuuguaucucgcucuuuuuuucuuucuuuuuuuuuuuuuuggagacagagucucacucuguugccuagacuagagugcagugguaugaucucagcucacugccaccucugccuccuguaaucaagagauuuuccugccuugggccccugaguagcugggacuauaggcauccaccaucacaccuggcuaauuuuuguauuuuuuguagagguggaguuucgccauguuggccaggcuggucuugaauuccugacuucaagugaugagacugccucagccagccaaagugcugggauuacaggcaugagccaucgcgcccagccagacuuguaucucuuaaugaguuuaacuacauuuaaccauguaugugucaguccuacuaugcaccuuacagcucacuaacccuguuuaauaauguauguuguuacauuuaaucuuuaugguagccucaugaacagguucuugaucaggagugauauugccugccagggaaugcaugucaauaucuggagacaucugggguugucaguucaggaggguagaggauaggggggaaaaggugcuacuggcaucuagugggcaaaggccagggauagugcuaaggauccugcagugcaaaggaccaugcccaccacaaaauaucagcagugcccagguugggaagcucugugccauugugcaaagauucaagguggcuaugucacaggacugguacauguccuuuuuuuuuuuuuuuuuuuuuuuuugagacggagucuugcucugucgcccaggcuggagugcaguggcguaaucucggcucacugcaaguucugccuccuggguucgugccauucuccugccucagccucccgaguagcugggacuacaggugcccgccaccacaccuggcuaauuuuuuuuuuuuuuuuuuuuuugcauuuuuagucgagacaggguuucaccguguuagccaggauggucucggucugcugaucucguaauccgcccaccucggccucacaaagugcugggauuacagacaugagccaccacacccgcccuacauggguauucuaacccagucuagugauaguccaaccuccuguacuaugaguaauuagcaaagaauuaacagcagaagaucgcucucaccaaagcccauccagaaaguggcucguauucaaggugcuaauuaggguguuuuguugccaguaaaaacaugagucagauuucaugauugauucaugaugacuuuaaaauuaaugcugcuguuaucauacaaaguagugguaaguggagguaagagaauguuuuugcuuugggguacuaagucaucguuauaauaaacacacaguaaacccauuuaucucaggcuuaaugcuuucuuguuucuucuaagcacuucuuaggugccucugggcuuuuuaacauucuuuggcaguuguaauuuauuaauugauuuuuaaauuuggccggugaaaaugaacuuuagguagggguuugaggaaaaugaaaaggccuauuuguuuuucaguggcugguucuucguguucagcauuaaggauugguagaaaucaggcaaccucuauguaaccucagccaucuuggauucccagcuuacucacaucauagauggagagucaguuguuuagaaaaaaacuuucuuuuuuuuuucuuuccuuuuucuuuucuuuucuuucuuucuuucuuuuuuuuuuuuagggagggucuggcuguauugcccaggccggaguacaguggcacgaucuuggcuuacuauagccuugaccucucuggcuccagugauccucccaccucagccuccugagucacugggacuacaggugcacacuaccaugcccagcuaaguuuguucauuuuuuguagauacagggucugacuguauugcccaggcuggucuugaacuccuggccucaaaggauccucccaccucagccucccaaaaugccgagauuauggguaugagcuacuguacccgaccaagaacuuucuauuauauagauuuuaauuaaaaacaguccuguugaguggccucuuuaucaaaugcauucucacauaaccucauagaagugagcccucuuacugaauuauguggcugggguucuuggguauguuuuguucuauuuucugguuggugguuuucuuucugucgggucccgugggcucuuucuggaccucuucucagaauguuuuucguuuuuuuuauuuuuugagauggagucuugcacuguguccugggcuggaaugcaauggcaagaucccugcucacugcaaccuccgccucucgaguucaagcgauucuucugccucagccuccugaguagcugggauuacaggugcaugccaucacaccuggcaauuuuuuuuuuauuuuuaguagagaugggguuucaccguguuaggcaggauggucucgaucuccugaccucgugauccacccaccucggccucccaaagugcugggauuauaggugugagccaccaugcccagcccucagaguguuuuaaaaugcauacuauuaaauaccuaggauuauaaagggagccagcuauacuuacauauaguucucucugugacccuguagaaugcacugaagcaaaaauaacagguaaugcuaaucauaaaguuuuacaaaucuccugaagagucuuguugguuuccguguugaugaagcaggaaauuucccugaccccuuugcaggcaggaaguggagugcggaugcuggaacuagcuggcugcuuuggugccaguagaggugaacugcacucacuugaacccccugcacuccaccccuucugggaggaagcaugcaggugagcaggugcaggagccaggguaaaugcuuuugggcacuggcaggaaugaacucuguacuggcccugggauagcaucuggcaggggaugcccgugaccccugaaacccuaaaaggaguguuacagucagugcucuuuuaguuuugccauccacggacggcuuaaguguuaacaguucaguggagggucagcgugacagccuuuugcacccacaucuggguucuuguccaguguccaggaggaacgaggucucaugagcaaauuuuaaggauggcagaugugggggauuuuauugcugaugaaaguggcuuucacugggaagauaagcuaaaaagaagacaaagcaggaagguaauuuuccccuggagcuaugccaucaagcuguucuucugaaguccagccgcuucucuccaacuguggucucuaauuuccagcugcuucuccucuuuucuucaaugugccagcggagccugggguuuuuauggguacaggauugggggcaggccgggccaugggugguuguggaaaaggcaauauuugaguggaaaaacagggauauauguucucacuuugggccacaguuccaggcuugaggauggggcccucaccacggaccugcccucuucugcccagaauuucccugccuccugucccuaucauugauaccugcaauucuuuguacauaugaaauuuaauauggugagauuggcaucuagcugcugcuagagauagugcucauaauaauuuuuaacauugauugaguguggauaauaauccaggagcugugcuaaacguuuuacaacacauuaucucacuuaauuucacaacuccauaaaguaguuuucacuuaguugagggaugaaaaaaguuaggcucugagaauugauauuacucugcaaauauggaauuggaauuucaaagcaaucuauggucuuuaucacuucuccauuaacuguccuuguuuuauuaaugcugauuacuuuuugauuugguuugguucuuuggaguuguuugcauuucaugagucuuggcaucuuuuugguagagaaccuugcuagguucucacaauguagaaauuaagcagaaaacagaggucucaauuugccuuuucagcgugaaugcagacucuuacauucagugcugggagucuuucuugagggacagugagagcgaggaaggguuuccauucuccgagauggaugguugcauuaguauuuauuuccuuuuuguuuuuccuuaggaugagaaagaaggcaguggagcccuuuuccuuagguuagaaugguucuguugguugaauugugcacccuguuugguugaaacaauuggacaguaaggaugugacuauuauuguugcucucuaauacuuuauuaugucauaccaaaaauuaucuuuuguauuuugcuaccaguucuuuuaguuucucuuacauguaugaaguuggauaguuagaaugagaugaaaauaaaugggcugggcgugguggcucaugacuguaaucccagcacuuugggagucugaggcaggugaaucacuugaggucaggaguucgagacuagccuggccaacauggugaaacccugucucuacuaaaaauacaaaaauuuuuuuguauuuugggauucgguuuaggugaugugugucuguaaucccagcuacuugggaggcugagacaggagaaucacuugaacuccagaggcagagguuguagugagccaaacuugcacaacugaacuccagccugggcgacagaggaagacucugucucaaaauaaacaaacaaauaaauaaauaaaaauuguuuaaaccugccaacuacaauaacuuuuucagucucuuucucccuuucccaccuucccaaaagggugggaaauuuuuaaaguaaaguaauaaacaaauaaguuuuggguugggcgggagauuaguuagagacaggaucuguaggucagaagugguauuugggggaguagggaguuuuuuuuuuuuuucuuuuucccuuaugcauuugggaguggaagagcugucagauucugaauuuaguuagauuuauaaugcuagagacauucagcagucugccuuucccuuucuguuauaaaaucauguuuuuauugaauuacauuuuaauauugguaucacuuuaaaaugaaaaugaguacuugcaaaauguauuuuugaaggaguuggguggugguggggggaugccauuuuggcaacagaugacuucgguucaaguccucucucugucucuuacuugcuuuguggcuuuagaccagccacccacucagagccuugaaauccucaucuuugaaaugaccauaguaaguuccugccuaggcucuccccugaagcugaaaugcaugaacaugcuuuguaauuuuuuuuaaggauugauacuagcuaggguguugauaagaaacagcaggcauaguuacugggugauugagaagaguuuaacaaaagacuguauuagucuguuuucaugcuacugauaaaggcauacccaauacuaggucauuuacaaaagaaaaagguuuauuggacuuacaguuccuuguggcuggggaggcgacacagugauggcagaaggugaaaggcacaucucacauggcagcaggcaagaaagaacuuguguagggaaacucucccuuaugauaccgucagauuccuugagacuuauuugcuauugugagaacaccuugggaaagaccugccuccaugauucaguuaccucccaccuggucccuccugcaacaugugggaauucaagaagagauuuggguggguacacagccaaaccauaucaaaaaccauuuauaaaacucuaagcagccuuaaaggaaaccaccaagggaccaaggccugaugaagcaagaguaggagggaacagaugcuuggauagggcaggugagucacaggcugaugggagcugccaccgucaguagagguccugaugaccugggagggugggagccagacagaugggaguauccuagccucaguuccuuuccauccucagaacuccucccagugccucucaauggcuaaaccaaccaaagguuggagcucaaggaagcuccugaggcuaucuuuacaggucagccaguugggaacagaguugacggagaggggacaggaggugacuagauuuggaaggaaaauuagaaaacuuuuggccgggcaugguggcucaugccuguaaucccagcacuuuugggucaguugagucuaacauagggguguccaaacuuuuggcuucccugggccacauuggaagaaaaagaauugucuuuggcugcacauaauauacaauuguugaugagcuaaaaaaaaaaaaaauccccaaaaaaucucauaauguuuuaagaaaguuuaugaauuuguguugggccagauucaaaguuguccugggccgcauguggcccaccagcuaugguuuggacaagcuuagucuacagguucuucaagaggggcuugagcauuugaaagacuucuagugggagagaucacaagguacaacuagaaaauccugggcuggccugagaggcagaccugugauuauuuugcucuuugaaaguuguccuucugcacccauuuuccccagaccuaaccucgauuugugcuccaggucugagcagaaauguuauucccuccagaaagccuucccuggauguugagggaugaaguuguaggccccucccgaaugcguccucagaacucgcugguucucguccucgcccucagcauacuugcucauuguuuguuuccaucucuaucaucucugugagcccuuugaggauggauguguguccaucuuguuaacaguuggcuccccaguaaccaguacagugccagauacagaguaguaacccuacauucuagcguaggcaaauauucuaguauuugccaaaacuagaggaugaaugagugauggguaagagaguucucagaaaaauggauauaaacaauauuguaaaucauauuuggaaaauaaauauuagaaucauugaaucccugaguuauagaaaaauuuauuaauagcgcuaucuggcuacuuuuuaaaguguggacauccucgauguauuagcuaugcaucuguggauaggaggcuuacccacucugagucuugucaaauaccaaacacaggaaaacaauaucuuccugagaauguugugaagaauauaucauccagucagagugaaucagcuugcccagugcuuggcauauagcugcucaagaaauauuaggcauucuuuguuauuauaaauccccuuuguauuuuaaaauccucauguaucacugaaacaaccaacugaaaaccauugagaggcucauggugaaagaagacagacaguguaauuucccuggaaacucaauuuugauucagacguccacagcaucucauuucugccuuuaaaaaauuucaagagugacauuuuggcaugacuggacucacagguggagaagguaugacaaacauucuggaaaucuuggaaggugaaauauagggaagauggccccuauggagguucauugucccccaccuuauucuaaauaaugacuuucuuaaaacuacauguuuugggggaauguccugcaauauugcuuuacaucuuuuuauuuuuuuauuucauuuuauuuuuuuugagacagagucucugucuccaggcuggagugcaguggcacaaucucagcucacugcaaccuccaccucccggguucaagcgauuccacugcccugaucagcuuccugaguagcugggacuacaggugcgcgcuaucaugccuggcuaauuuuuuguauuuuaguagagacuggguuccaccaugguggccgggauggucucgauguccuuaccucaugaucuguucgucucagccucccaaagugcugggaugacaggcaugagccaccgcacgcagcguauugcuuuauauuuuaagacuauacacugauauccccgagcacccaaguuccuguccgcugguagaauucacaaagcugguuuuaugucuccuucucuuccucuuccaguguugucuuuucccugcauugagauagcauugcauggagauccuuguacucuucgaacagaggcugcagauggacacaggaucugcucagggagauaagaucaccugcuaauucugcuuucuccaucagagucugaaugaucagugauggggaccagagcuagguuaggucucuggaaacgcccucugucugaguccgggagauggaugauauggguaaugacuugcugcuuuaucuucucuccaucuccuuacagcagcuccaacuacugacuuuuauuguguggcagcuaauuguaggauucuauuucuguaaagagaaggcaagagaggaaugcaguguccaccaucccugcagcccuuuggcgccuucccccucccauuaccuugaaguagagggaaaggggacgacagaagaacccuuagaaguaagacuuuuucugucucugaugccacggaccuuugaaauauuuuuuugaaaagaaggccucccuuggcugauaccuucugacuguuagugaauaaaggaaguuuaaacaaucucuucccuguaaucauuaaucucgucuucuuuguuacaauguauguuguggucuuuguuacaauguauguucacgaauuccuagaacacuguucccguuggccaugggaucaggggaagagagaaggaagagagaaccagacacaaguuggagggaauccaucuccagugcugcucagagguaugaccuagagcaagggguuuaggcuuucuuggacucauuuuccucgguggugaaguggggauaauuuauugacaguggaccgugagguucugcgcacaaaauucguugcauagcaccugauacacacaaagcuuucaggcaagguuaguuucggguauuuccagccuuagucuuggcugugggagccauaauggaguuguucagaaguuuacagcuaguguuuauaaauugcuugccauggggccuuguauacaguaagcauucauuaaguguucccuccuauuauauccuuagguuuaagauacaggcaccacaacauaaaccacccccagaguacacaugcauggguguaauuuggugccauucuccucccuuuugcccccaccaaaaugaaguuuuuaguguaaaugucauguagauuuuaaccaaagguugauuggagggucugaguuucucagcuaaaugaaggcaugaggacuguaucccuccugaagggugugaucaguuccaugagaaagaagcugcgagcuguggggcauccaagauaauguaaucugccccgggguccugugagggacuggccgacaaggcaggcugaaugcagccuugcccacugagcuggguucucucugcuuuagguccucucuggaggugaagagggaaguccgcugauuguuuuucucuuggugcaacuucgcaccacccuuacauaucccaguguauaugguagccaaggacaguacuguuugagccucccccauuaagugucaacauugaaucaaugcaaucccaugcaaagaaagcugagcaugggauugugccgguuuagccagcuaaaguguggucucugaugcugaucaugacuaugaaaagggaaaauggaggagaaugaugacgaaggaggaggaggaggaaaaggugacuugccucuagcugauguggauuauuucucuuuuuuaauuuccaugucuguguagcuucaucauagaucucagcuuaaggacaaugaaagucguuuauugaguacuuaguaugugcugguugcagagccaagucuuuuuuuuuuuuuuuuuuuuccuccuuuuuugagagagagagucucacucugucacccagacuggauugcaguggcacaaucucaacugacugcaacgugcaccucucagguucaagcaauuaucaggccucaacguccugagaagcugggacuacaggcauguaccaccacacucagcuaauauuuguauuuuuaguagaggcgggguuuugccauguuguccaggcuggucuugaacaccugaccucaggugaucugccugccucagccucccaaagugcugggauuacaggggugacccaccacacccagccagagucaaguauuucaaguauuagaguugucugccugccucccugucucccugccuuccuuccaucuguuuguuaucugacuuaaucuuugaaauaacccaaugauacaugauaugcauuuucuagguagauagaugaaggguuaggaagauguaacuuguccuaaaucacgugucuucuaagcgguggaacugauuuucucacugacuauagauguugagcccauuaaugugauaccuacugccuuuuaauuuuaaaaguucucauuguuuuaucguuuucaucauuaucauaugauuuaccucuucucuugugucuuauaauccgauuggucaugcugacauacuaaaccauauuguuugccacugggaaccaauucaucugugaaaagucauacagauaggcucgaagaaagagcuugguugugauguuguuguugugacaacugucucgggggcuggaguuagagccagggucccagcugccacaguucauguagggguagaccagugcuuccuuuugggugaugaggaagcuggauuuggcagcugguuuugucuggauuugaaagggagguaaucaggggugugcugggagggccagaacgauccacccacguguuggugccacccggcaguggaaaagccucuggccucggccuucuccggaagguuguccgcggugccagugagagcugcuuuucaccuuacagcagccccggccuaucucucaggaggccugcugauaaucaguaaaugaaauucaccuuuccccgauucuugaaaacggaaaagaugaggguugaauuauagggcaaaucaugaacacugucuuuuuuccagcaugguauuuugagcggcacagaaggggguaauuauuuuauuuggaagaacaaauuuaaguuuggcaguuaccugaaagaaaauuuagugauugccaguccauucucuagccuucugaagaagauagauuguaaucuuuaauuaagcuaucacucacaccaaaaaaaaaaaaaaaaaaaaaaaaaaaagcggggcaagggguuggagaauguucauaucacauuauuuuggaugucugggguugcaccuggaagcucagauagcaauaucuaggcacggcugccagcgcucuauacauugacguuuguuuaauauuuuaauuuccccaugagucuuaaaccucugcguggugugcaaguugaggccugguguaugcacuucggccacgggcuuucccacuguaaugaagauggaaugacuccauggaugaccuuuccgugccuuugucuguagccugcccuccucuuuaacugaacaccuuccagacgagcaugcucugaacuccugaacugcucauucuguucucugagagaauugcucaagcugcaguuuaucauuauaugccuccaaagacuuuguguuuccuauguuugacaucgagauagaauuuuucauaacccuuuacuaguaauaaauuugauuguuaagggaccagguuaaucuuauuucuaauaccagcaucugauuuuaaaacccugauuuaggagcauuuucuuucugcuaccuuccuaaaacgcauggguggaaauguauaaaauaugucaccugauauuggaggauuguuuauuucuguucauuugguccugaauaguaccuaugagaugcauuugaaaacuuaccuuguuuauauguuucuucuguugcaauuucuuccauuaccuggaauagcugcuuuggacggcaaaccaagcaaugcccuuucacagcugugggaugaauggggaaagaagucuugguaaggaagcaauucagagaacauggaagcaucucauggcagcagucacaauuuuguguugcguaauauuucaggaacuugcaacccugauaacuugugccugccugucuguaggccuuuaaugauguuuuauugaauuuugguuuuccccuagacuuugcagugcaugacacauaguaauugcucaauaaauauguguucaacugaacuauggugguuagguuaguaauuagaugcacagacaaaaucacaggaaucugcgugagccuuguccuacugguaaaggagucuugugaggauuaauugaaauaacucgcaaaaauauccagcucucuguuucccugcuaggggcucuugucauaggagccauuguuguagccuuagaaaacauacagcauuauuuuagggggagagguuagaguagaauuuuaaagagugcauuucucuuccaguaagcaauucugcaucgauaaaaaguggagaaagaauaagugaaaaaauauuuaguuaauucuuguugacagaaguaggacuucagguccacauauauuucauuguagagugcacacaugcauuuuuaagaauuucccgauucucuuccacguguggacagauuggcacauaugugugugugcaaauuguacuugcaguggcugccugggaaaugaaauuucugcaccuugccagagcauguuuucccucuaaagagaggcagcucauaauuaguaaugcuaaugucggggugagaugcaauagauaaucuaacaccagcaaugaugcccagagcauuuaucuuugaugcugggaaugcguucauuuucuuuaucuugccauuacuguaccucuauugggaaauuuacucucucuucauagauaggaucagauccaguacauauuuauaaaaccacacuuacauuuaaauacaggccuuucccauuucacaguguuucuagcuccccuuuccaauacaucucucucucucuuucucucucucucucucucucucucacacacacacacacacacacacacacagccaaaucagacaccaauauaaacuguagaguuaacauucuuuuuccacccucacacuuuuuuuagcuccgaucuguguucaauuucugccugagagagugauauauucauauauuuagguauaguuagaaaaagcaaaaugguaacaauagaaucuugaugggauugaucuccugcagcaaggagcaacagaaaaaaaaaaaaauggaaucaagaacccaggugcuuuuuauagguuaauugugcaggguuaucauguaucucuuuaaaaucaccaucuugauucugagcuuugguucuacacauuagaauuguugccugggccuggauuuuuccccuugcauguugcgugugguaguccagcacauuugcugauugcaaauauacuugucucuucucaugggcauuacuaguacucaggaaaucauugaugugggguaaaaugagaaaaggauuaguuuuauuuuggacagauaaacaacaugucauuuuaccaauugcucauuaaugcugauauuucccgugggucucugacucugaaaucugcauggagugguuacacccugggcuuguuagcuccuaccugagcucugaguuucuguggauuucuauaggcuccugcaaauuuuaucuaguggauauuuuguuaaaaaaaaaaaauggggucucauucuguugccccggcugcagugcagugacaugaucauaacucauggugaccucaaauucaugagcccaagcgaucuucccaccucagccugaguagaugggacuacaggcaugugucaccaugccaggcuaauguuuaaaaauuuuucuuagagguagagccucacuuugcugccuaggcugaucuagaacuccuggcuucaagugauccuccugccuugagcucccgaagcgcugggaccaauagagauuucucugagaauuaggucccccacuauuaauaaggucauugucagcugaguuggggagguggcguggguagauacaauuaauuuagauuuuuuaaaaggcuuuugagaauauucggagaaccuaauauauuuugagaccugacauuuauuuuaaacgugaaaagcaauuuacaaaauugcacauacucuauaaauacacuucuguuauaaaaauagacacguacggccgggcgcgguggcucacgccuguaaucccagcacucugggaggccgaggcgggcggaucacgaggucaggagaucgagaccaucccggcuaaaacggugaaaccccgucucuacuaaaaauacaaaaaauuagccgggcguaguggcgggcaccuguagucccagcuacuugggaggcugaggcaggagaauggcgugaacccgggaggcggagcuugcagugagccgagagcccgccacugcacuccagccugggcgacagagcgagacuccgucucaaaaaaaaaaaaaaaaaaaaaaaaaaaaaaaaagacacguacacagacaaauguucugacagaaauacacugagauaucuacagugcuugucucuggauaggauaggguauaauuuaauuguuuauaguuaaguuaaugaacuuggccagacagaccugggaucaaaucccgccucuaucaugaauuggcugugaggugugacauugaaaaagugauuuagccuuuguuccccuccagguccuuaucuguaagguggcaguuacaauaauacccaccucccaggguuauaugucaauggguuaggcacagaccuaggaacucagcaaauggacuacuaugaaguauuagcuuuuuacuguuucugguuuucugauuuuugucuccuguugugaacauacguugcuuuuguaauaugaaaaauaaaaaauaaaaguuaaauuuguuuuguuuguaagaaucaguugaggacagaugggacuauuugcauggauuggugucauguuugaagucaguuaccagaggguuucuuucaacagaguauaccaaaaaaaaaaaaaaaaaaaaaaaaaaaaguaaauugcacagaccccagcuuaggaccuggacuuaaucuucaugauguuuguaaaguaauacuucuuggagaaaccucccaaauuucuaucgacacuagacaucucaggauuugaaauguuaagcuaacagaaauuguucaucagguguaucuccagcccuccguaaacacugccggauggaugaaccuacguaaugaucuccuggugccauuuuccugacuguagauacuuggguaaggaggagacuuugacucuagaugacaugauguacccuguguucugcaagcuggagaacaucauguagaaucugaaaauuaggagagagaggcaaucagaagaagacagagugguguugcagggaccugcagucagccuagucccccaguuugcguuugaauuuggucccagauuuuuuuuguuuuuguuuuuuaguaguuaaagcugagagcaaaccacauugcuuacuauugucagggaaugaaaacuaugcaacagaagccgaugugcagaggugaccguguucgcuggaauugaacuuaagcagguuccuaccgcacagauccacacaggagggauugcguaaugcacccagcagaguugugcucaacugugauuuuauaaaagacacagaaacacauauuaaauagacaauucuucuaucagcccucuaaacuggcauaaccuugaaucauaauucaaugaaugcauuucugugagaagugaagguaauaagcuccaagugcuuucguuuccuuucuuucuuucuuaaugcagggaaaauugagaugggauucucaguuaaaacccaaacgacgggccuggggguugucacaaugugaucccugaggauguuagccccaaugucuuucuguagccagaaccaauagaaaaaugagaggaggagaguagaagcagaauagcaaacaauuuuuccuuucauggucuaccugugugacuguguauauguccagaaggggaugugguuggggaagggcauaguacacauauuugagcagaguacauguguuucauuucuugcucauacgacauguccagugugggcuggcauguucuucugcacagucccugagggacccggacuuauagagucugugaucucacagcugcuacaucuggcacagauggccuucuugaucuccaguuagggcgagucacaacagcaauuaaaugguuuggucugaagugucacgagucguuuccucuuggcugccuacuggcuaggccagucacguggcccugaagagggugggaaugucucaucccccugugggcuuagaagaaaaccagaggucugugcacacuauggauuuuuacuacaaugaugcccuuucacauacagcgagaaggauuaagagguacuguauuguugguugauaaagucaaacuugugaacagagcaaaagggcauugcuuggucauugcagcuuccacccaugcaccuuacacagaaguuugggcccuaacauggaaacuuuucaacacuggccaaauucuguuugaagcacuguauugagcauaccauaugcugaaagacuuggaaugcaaaaaccuaaggccaagggcacuucucaauauuaaacccucaguuguaauggaggcaucaagacuauaagacccaagaccuuaacuuuugugcuccuugucuuguggagggaacauccauccucaaaacagaaaccugugagaucccuugaauauacugacaauacacugaugagaauugaaugccccauaaauugcaucucccgcagggccugauaggugcccugucuuccugcuuaugacucugaaacccuguuuauuuguaucaaggacgguugguacuuuaaucaucaauaaacuaacaucucaacagccugccauaaauuucuugucaaaaaaagagguuaugauuagaauacugugauuaaagagaauuuguagauagacuuacaucccucaguuucaaagcuucuaguaguagggcuuagagguuccuagaguaggaaaagccuagccaagcagaaacccauguuuuugacuuucaggauauuugugaauuaauuuacuugcauauauuggccaagaucuagcauaaucucuuaauauucaaugaauaaaaaauugaguuuugagagcaaauauuuugguaggaaauagagaacugacacuaauauucucucugacuauaauuguaaaacaguagaugucuuucaccaagcgcuaacauuauauuaauuauuaauaaaauccaacuccuuaauaauacaaucauaguuaccauuuauugagagcacucuucugaacauuuugcauucuuuauuuaaucuucccuacaaccuuauuaaguagacauuaucuucaucuuauuaaguagucaguuccucauuugcagaugaggaaacuggcugacugaguuaaaugaaugccaaagucacagagcugcugaguggcagaguuguaauucccaugcagaacuguguggcaucaaagccauuuuuuaacucauugcaaugcacaguggguuaaaaugagaugauugaaaaugagauguggcugggcaugguggcucacaccucuaauuccagcacuuugagaggauaacuugaguccgggaguuugagaccagccugggcaacagagccagaccauccaucucuacaaaaaauuuaaaaauuagcuggguaugguugugcacuccugugguuccagcuacucaggagacugcgguagggggaucacuucagcccagaaguucaaggcugcagugagcugugaucgcuccacugcacucuagcaugcgugacagagugagacuaucucaaaaaagaaaaaaugagauuauggccaggggugguggcuccugccuauaauccuagcccuuugggaggccaaggugggaacaucauuugagcccaggaguuaaagaccagccugggcacauagugagacaccagcuuuacaaaagagagagagagaaagaaagagagagagauuauuucuagaauaagcaaaccaaacgugaauuaaguuuucauucucauuuuagugauucucuaaguacauacccacauucugauucccucagcacuuuaggacugacugauuagcaguaacugcccucccacugguaccacuguggccagggagugacugcaagggucaaaacuuuuguuggggagcuguuuggacuaagugaauguccagccccaacucagggauguuguauugguucuaaucucugcuucugaggaaaugguuaccugcagggcgauuguggccugcuccucgugggauauauugagaugguuccuuuuaauccauuucuuuuaaaaaaaaaauucuuuuuaaagagaugggauuucauuauguugcccagguuggccucaaaguccugggaugaagagcuucuccugucuuagucuccugaguagcugggacgacaggugccugcaaccaugucuggcuuaaauccauccuuaaacaaguucaauguuuuauuuccuucagauaaaaugagaguggagagaccacagugaugcccaggaauagucaugguuggcgauuaaauagccauugagucucuauucugaaacaggcaccguguucauuugcuauggcuaacaugacaaaauaccacccacuggggauauuaaacauuagaaacuuacugucucacaguucuggaggcuggaaauucaagacaaaguugcuggcagggucucucugaggccucucuccuuggcuugcagacggccgccuucuugcucuguccucacguggccuuccgucuguuucuuggugcacaucccuggugucucuuccuccucuuauaaggacaccaguccucuuggauuagggcaccacgcuuaugacaucauuuaacuuaguuacccuuucaaaggcuuugucuugaaauacagucacauggaggguuagaacuucaggauauaaauuugagggggacgcaguuuagucuguaacaugcucuaugcugggcacaaggaauguuaugguggauaaggggaaaauggucccuacccucugucaguuuuuuauggaagaagaaagacggucuuuaaagaaauuuacauaauuaaucacaaaaagcuaauacuaugacaaagaauguaaguuacuaauacagcuuagaacagaugacucuaaccuuguguaggagcuagagaaggcuucucugaggaggugagguuggaacugaagcaugaaagggaacagaagggggucaggcaggagaaggcuugggaccaggagguagagaaaacaguagugugaucagaacuuuaaggcccgguucuguauacaacagguuucgggacuugaaaggcagcccacauugaguguaacuagaaagugagggcaagagauuguucaaaagaauacuggacccagaguuucaucacuuuguuaauuacaucucauauugugggauugcaauuaccuugcccaagaaaagauuauuuacgauuccauuguuuauauuguuuguugaaauaauuaauucucaaaacuucuggauaccugagacucagcuaggaacuuauuuuuaaaauauaaauuccuagucccacucccuaaagauucugaguuaguacauucaggauggggucuaggaaucaguguguuuaagaagugcaucagguucuucugguacugauuguccaugaaccacacuuugagaaagcuccaucuaaagagauaaguuacugacguguguuaccagagagagccuagaaaaccugggcacaacaguaguuguuaagaacuaccagaccugggccaggcccgguggcucaugcccguaaucuuagcacuuugggaggcugaggcggguggaucacuugagcccagggguuucagaucagucugggcaacauggugaaacccuaccucuacaaaaaauagaaaaaauuagcugggcaugguagugcaugccuguggucccagcuacuugggaggcugagguucgaggguugcuugagccugggaggucaaagcugcagugagccaagaucaugccacugcacuccagccugggagagugugagaccuugucucagaaaaaaaaaaaaaaaaaaaaaaaaaaaaaaaacaacuaccaggccuguuggaaugucugccaguuucaacccacggggauagggugagaugaacauugauugagccuuuacauuggagacacuauaacaaaugcuuugcguacaucagcucuuucaaauuaauacaauucuacuagagggggcacuauuaguauccccaauuuacagaugaaaaaaaugagggacagagagguuagauguguaucuaaggucacauagcucacaaacgacacagcaugcacccaaaugccagguuucaaugacccuguggugaagugugauugcuggcauuugccuaguguugacugugcucuagacacuguauuaguuacaagugauucuacuucucauucauuaggccauccagaaagccuugugcuuuagucuguccuggcuacuauaacaaaauaucauaaacuagguggcuuauaaacaccugaaaucuauuucucauaguucuugaggcugggaaguccaagaucaagcugcuggcagauugaguguuuggcaacggcccacuuucugguuccuagauguucaccuccuugcuauguccucauaucgugggaggggcaaagggucucucuaucuggccucuuuuaagcccuuaacccauucaugaaggcuuugccucaaugaccuaaucaccucccaaaggcccuaccuccuaauauauuauauuggugauuaaauuucaacauauggcugggcgugguggcucacaccuguaaucccagcacuuugggaggcugagaugggcagaucacuugaggucaggaguucgagaccagccuggccaauguggugaaaccccgucuuuucuaaaaacauuuuaaaaauuagccgggugugguggugaaugccuguaaucucagguacuccagaggcugaggcaggagaaucacuugaacccaggagguggagguugcagugagcugagaucacaccacugcacuccagccugggugacagagcaagacugucucaaaaaaaaaaaaaaaaaaaaaaaaaauuacgaauuuugcgaggacgcaaacauuuaauccguaguacugauguggauaugauuugagcuaagacucugcuguugauucucuucaaaaacuuggcaguagcccuuggaucccauuaauugcauucaacagucauguauuuuauuaauuuuuguuccuaaagaaaaaaaaaauccagauugcuuagaaaauaaaugugacucacgcagagcagaauccgaauuuucuaagugaugaacauguuaacauauuauuuuaaucuaaagacauccuaucccugaauuuagggggagacauuuuuuuaaguaagguuuauuuuuaaaauuguuuugcaaacauuuuaacaguacaucacugccucauuggaugaaucauauuuuuaacuuucacuucccaucaauuuaaacaucaucucucaaggaacugaugggccgguugacucuaaaugauuuugccuuucaugcaguauuguuccauccgccugccacagaagugauuccaggucauuccaauuuauuuaauuaauuuuggagaugaaauuauuuugcccaauaacuagaaugcuaaugggacuuaguguaaugguuuaguucagguuuguugguuugaaaauaaacgccuucauuucaauauuugccuuuuggcugcagcccguuaacuggucacaugcuguaaccucauuaacaucaaggcuuaauuguaaguuaaugugcaccuaguuuuuguaaagaagguuucuaucuuaacugccaaguuuugccccccaaauauagccccaaacuggcauuuccaacagauggauggguugguguaauauaauucaugcuuuuaaacaucauacuuuuaucggugccuugauaauaaauauuugaacuuauuuuuagaaguuagaauaaagugaggaaaauaaaucucagcucucuagagugucacugugguauugagauuuguggagguguacuacauccguaauugggagagauugccggucguaaaggagggacaauagaaccucuguagaaucaaaggcagaauuaaaaucugcauguuaauagcuuuccugccagccacgaauagauucauucuucacgucucagauauauaaagcuuauuucaaaauaaauucuggggagcguucaaccugauugaaucugcuguaagcucuguuaauauauuuguucgagucacuugcacucaaaagguuuuuagacagaauaucacuuuuuuauauuauucaugguaauguaauuccccccuuuaaucucuucaggguuucccauucagucaugauaugcgguucagagaaaguuggaucgaccauuaaucaugcuaucucgacuucugugugucuccuuuuuguccaucucuuaaaucagucacuuggcagcagcaagacauguggccacuccagaccauuugaucgaagagcucuuguuaggagauuaggcugcuaaucugcaagcgagcuaauggaaaucauucugggcaaggaaacaaaacugaacaacauuagcaaaaucacuacauauuauaggaaucaaguacauucugaacggcuuaauccuacaguuuagauaugaagccuaaggguaagaugaacgucuuagaugaucugagauauccaaauaccuguaacaaacauuuguaugguguauguagggcaggaaccccaucagaauuggggaaucuuuaaaggauuuuuuauuuagccagauaaaauaaacaaggacagaguugacugagaaaaaagaaagaaaaaaaagaaaagucaggagaggaggacugaaaauucccaucccacccccgcaacaaugaagggaaaugccuagguugaaaacacgcaauacacauucaauaaauguucaugguugaaugaaguuaccugguagggauuuaaucuuuauuucaaaaagaguggcugugaaucuuuaaaaauuucuuugguucuuuaacauucucuucuucacuaaacccaaauuaauaauuccuuacuauugucauuaaaaguucucacuggaucauuccauuuauacucagaguaacaaagcaaacccaauuauuugagagacacugaaaugaauuuugagucuagaacagcaucugcaaacuuugcaaagguucacaugauaaauauuuucugcuuuguggccuacaagguaccuaucacaacuacuaagcuaucaugcauuagugaaagcacauagauaaucuauaagccaaugggcaugguugugugacaauaaaacuuuauuuagaaaaacaggugguagacuggauuuagcuuguggguuguaguuugcuggccucuggucaagagcacuuguuugucugggagacauaauuucaaaaaucauuuucuuuuuugauuuucaugguuuuagaacaugauauuuucuacuauggaugaaugcuccucuuuugaauuuucauuuuugucugacauaacucaaagugcuugcuuugggaguucuuguuaacccugacaauucuugucaaauaucuuacuccugggcugugcuggggauggcagcagaguggggugguuggaugggaaggcgggaaagagcuagcuuggagaugauacgcuuuuccauccuugaauaacuugggaaaaagucaggaguguggaaugaagaauuggaauauaaaggcugagggcggaccuaauuuuuuuuuuaaggauuaagaaaaaaggaguaagagagaugguaugacuuaucacuuggcuggggacucagcauuaauugauaaauccacuguaaggaaugcaugacacugucuuuugaagaaagacauugcauguuaggauucugaguaacagucaauauauucagugaaacaaauaccuaauauauuccaugaaacaaguaucgugaauauauuccaugaaacaaauaucaugaauauauugugugaaacaaauaucgugaauauauuccaugaaacagauauccaguauauuccaugaaacaaauaucaugaauuuauuccaugaaacaaauaucgugaauauauuccaugaaacaaaauacugugaaaucauaccacugauuuuugaagaaaccuaaugaaaacagcaugcuccuauaucuuuuuucugggugaucuuuagauaucucgucuuccaaacuuuuguguagcauugucugaauuuucccaagaaaggaggauguugaucuccuauuuauuuauauuuauuuaaauuuuuaaccuuuacauugacccaguguuguaaggaaaugggagaauauugcccugaugucugggaaauugggacucccauccuacaauucaaguguuggaauguugcagggaggcugggcuaagguguucuguuccugucucugguucaaaggaaaggaauagccuagaccuaaaggauucugucugguagcuguuugcucuucgcgccugugcuuugaauggugaauacccucggcgggaggcaggcaccugaugccacugcccccgccccaccugcccccgccccguuucucagaucacacaggcaggcugaggagcgcuuaacaccccagccucccaugaagcauccugaaaaagcagacuuugucuuccuccaucagcuuuguuuguccucugccgagacuccagggacaugauugcucuucauuuuacgcucgagaucaaaauaaacagaaaccacuuucagcuuucccguuccaggguuaagugcccaagcagguguuguuucuguuaugugguuugcagugagcaaaaccacccccucuuaccuguggcagcaaaggcagggagacuuugagaccuggggagggcucucugcuguguuaacagaacuggcucuugguugggggguggggggcacccauucuuggcuucuuauaacacuuccuuucucaugcauuaccuggggcucccucuggaaagaaaaugguggagagguuacuggccugaugacccagggacccaggcaguccuuacagggacccagaauuucacaugcaaaugugaccuccaauuaaagcuggacuugauuaaccccauuuccccucaaaagaugauacuuguaaugccguuccgaugaggccgucucacuccguaaacugucaucugauuuacacaaagccaucugcuuccauacgggguguuuuauuugggauccaggaggggagaaggcgcaucugcccccuccauagcaucugaaucuuaaugaauaaaagcacugacacuucuuuaaaagggaauagcgugaugcuauuuacaguuuauacaguuuuguaauccagcuccaugcuggauauuuaccgucagucauuugaggaaguucacuucucugcugguuuucugagugagggagcgaugaguagaggagcagcuggaggguccaggagcccccugaacugaguauccggugggaggucagauuuccgcauucagaacgagagcucauacggcauccacgcgugucuuucucaugcauauccccagcccgaguagaagaggacuucugcaucucuguuaguucuuucuccuccuaagaaaaagcagauuuuaaguaacuuaucauuuguucauuuaauuacucauucuuuauuccuucuucauucauuuuccuuuucuccuuccuuucucccucuguucucucuguuuuaacagguuuuauucuuauugugguaugguaaggccaagaugaggaaaugacugcuauugcaaagaugguuuguuacucacagauccauggggacuccacaugccacagggaguuaccugggaaagccccaggguugggcaggaggcagagggagagggggagaacugucaagaguuuugagcuggaagcuauuauccucagcaaacuaacacaggaacagaaaaccaaauaccgcauggugucacuuguaagugggagcugaacaaugagaacacauggacacagggagggaaacaacacacacuggggcuugugaggagugggguugggggagggagagcaucaggaagaauagcuaauggauguugggcuuaauaccuaggcgauggguugauaggugcagcaaaccaccauggcacagguuuaccuauguaacaaaccugcacauccugcacauguacccuggaacuuaaauuuuuuuaaaaaauguuuuuauugugauuuucacaggaaagaaggggccaggcaggguaagcaggcuuaggauuggcuggcuugggucauuuccaugggcucugggacacagggguugucuuuaggugucugacccauggcuauggggugauuaggguagguggguguggccuggaguucgagcccaauaaagccaguggugaggguguggcugugaauugguugguuugcauuugaacugugguuaccagugagcugucuacuaucucuaagaauccgcuagagcccuguaaagaaagccuacaagggagcagguuuuaggcaauaauaagugagcaguauggcgcccuaauagaaggagggaugccuguggccaauauacacggcucaaaguugaccaugauagagaaccuuucccuagaaggucugugagggaggaggccugggagagacagcagggugaccagaguaagugaagucaccgaggugccaaugaguguggcccugcagguccugcagaccccccugguggcaguauugguggucacagcuggcaaagggaaguguggcugcccggagagcuuggcugagguuggaacgugggaguuuaagagagcaaacucccacagcuuggugcagagagaaaaguguagaaaggucgggugucauacagcagagggcugugaugcucuacugaggaguggaaguguuuuucugagggcaucaaacacgccgucaagcagggaggcaacaaaucugaguuguuccacagauacuuugagugcaguacaaguugguaauggguaacaggcuaaaccauguggcaccccuucccucuuaucagcuucuugcuaccaugcagaaaagugcugaagguggccugcccuaaggcaguagcacuagagcagggauggggaggacuugguggccagaugcauguggacaugauggaaagggaagagaagaacugucaagauuuucacuaucagugguauaagccccguaguaauaugccuaguguuccauuauuggaacacuaaguaugugggaauuauuuauauccuaccgcucaaagccaucaccaaggucugaucgugaaaauucaaaaaauugcaaccugaggcauaaauggguuuuaagcuccauacaguaaaaccuagcauaugaaaacaguucuggcugauggguugguagaagugauagauauagauacauacauacacauauaugcacaguaauagauauagguaaagaccuugauauauguacauauauuguaugauacauauccaugcauauacguggguguacacacacagguacacacaaauauauaugugccuuuggacaagaaaaaauccccaggacagucucauuuggcuuuuaaaaugcugcaguugaauaggaccguagagguggccuaaggcagccuuccauucagggcacgcagauuugguuccucagcucccuucuucucuauuucugagucacgugggcugcaccuaucugucagaagcccacugcccacccagagccccugacucugaaugguggcccagugcuuucugaagacagaggugggaccuggugcuggagacaauccauuccuuucacaaagacuguaagccuuacccaagcauuaauuuugcugcauaggcggccuguucucccacaaagcacugaguaagaagaaaaggggcccggauaaaccagcagggccuggcagacaacuucuggcucccuugccauuuaaggucccgaggaauguggagacauuggugggggccaggguggguuuggaaggacggauuuuuuccucuuugucucuaucucucuuucucucugucuuuuucucuuucucucauaguuaaugcuaugauuuuguaaaaaaaaaaaaaaaaaaaaaauucuaguuucucagaauccucauuggaggcauguguauauuucuaaauuuaaauguauucuccuauacuguccggggaaaggaagcauuuuucaaccaaacugaaagggaaagguacucuuuuuuauucuaauacucacauuucccaaaacauauccuuaauauuguacauuuggcacaguuauuguugaauacuuggaaggcgauguguauagcauacagagcugcagcuuuggacuuuguggcuuuagguaaauuacuuauucucuuugcaccucaguguauucuucugacuaauggggacaguagcaacaucgaugucucggggcuucugugaguauucaucaagguaauauaugcaggccaguaccacauuccccacuaaaggagugccacuuuuuuuuuuuuuuuuacuacuugcauuauuguuguuguuguugcuguacgucugaagggcuuuaguccucuuaugagcaaggcaaaagggacaauguucacccuuuggacuggaaguaagaagccccugcaguuccaaaugacuccacauuuggaaugauuucacaaggagugcaaaagaagccucuuguuugacuuugcccacaaaugccagaggaggacucuucugagccaugccaauaagaaaaaugagaaugccagcuuaaauaaauguuaucacaaucucugcagaaucgugaugucuccgauucuuaaaagugucuacugcaggguauuuauuauucugugauaauaauaaaucgcugcuuaugaaaugcaaggaaucgagugucauggaggggaggaagggaaguaacagggagaagaacugugagagauggagguccagccaggcccgggcuauuaaucaucgcccuccauuauuuccugaagauucauucauuguuccauagguaccuagagggucaauuagagaccacagacaggcuuuuucaaagacgcaagagggucaauuaggcccuccuuauaauuuucugcuuuaacagcaaaugccagccuaucgugcaucagaugcaagggaguuuggaaauaaacaggguacuuucccuccuccucuaaaaaaaaaaaaaaagaaaaaauccaacacagagacauggagacagucggcgauugggaacgcuuggcuugcuggcugucaggaucugguucaaggaaggcaaagggaauuuuaucaccaacugggacuugagaggagcagaguucuucuggucucagagcacggggaacggucagggaauuuguaugauggagcacccuguucccauaucugagaugauucauuuaucuugagugccaucuuaacuacaauuagaguacaauuauaaaguaucuacaauggaaaugggucuugaaaucaaucgcagcuggaccggcgugcggugaguugccgugcccaccacgacugcugucuguguuuaggacagaguucaaccaaacguaccggugugugauuuugcacaacacugcuuuguauuuguuuucccugagaccggcaaacacauuuuuuauuuauuuuauuuuuauuuuucgagauggacuuucgcuuuuuugcccagccuggagugaaguggcaugaucucggcucacugcaaacuacccccgcccccggguucaagcaauucucgcaccucagccucccaaguaacugggauuacaggugcccaccaccaagcccggcuaaguuuucuauuuucaauagagaugagguuuugccauauuggucaggcuggucuugaacucuugaccucaggugauucacccaccucagccucccaaagugcagggauuaaggcgugagccaccgagcccagccggcaaacuuacuuuaaaacacauugcaauaaaauaaaaagaaaagggauuguccuaagugagaagcagagaugaaaauguggaaggaugauugugagaaguccacauugcuccauuuggacuuccuuuuuguagugggcuauuagauuuugccucugcuuguuucugaauacccaagcuugcuaacacagggaaagaccaauuaucaugauuauuauuauuuaccuuaagaccugauucuaccuaucuaugaucacauagacauuuggaagcaaagagaaaugcuuuucaugugggaaaaaccaauaccaacuucagugauauuauuucuccgccccccgcaccgggcucuugggaauaucucuuagcccucaauugucacauucauucagcagauguuagcacgugcaggcaccauucuagguguuggggauacauccaaaaacaagcaggaaaaccccauucucuucauuucuggaaugccggagcacugggcccauggagcccguuucacuuacacguuuuugucgucuuugaguuuccaagaagggaguggcacuauagcugaagaggaugacccucuaucacagccuuugcuaaaaccacugaaaacugucuuauuuuucauuuugcccggaaaugcgacacauaagugcauuccucuagggaaggauuuuuuuuuuuuuuuuuuuuuuugagacaggagucucacucuguuguccaagcuggagugcaguggcgcgaugucagcucacugcaaccuccgccuccuggguucaaacaauucuccuacgucagccuccugaguagcugggauuauagucaccuaccaccauacccagcuaauuuuuguauuuuuuaguagaaacaguguuucaccagguuggccaggcugcucucgaacuccugaccucaggugaucugcccaccuuggccucccaaagugcagagcaggaauuucauuggauuucuacacugcugcuuuuucagagccuggaacagugccaagcacauagucggcccucagugagcauuuguugacuaacuuaggucacagauguggggcugugauucugaaggccccggcucauucuuggcuuucagagagguuugcuuucacuccugggcagcagcugcccuggcugcugccaccaccgccuucccggaggucagcuuuauuuucaguguuuuugcccuuccgaucccuggguaagaaguaagaaaauuucuagugccuggagucuccauccucguuucccagucauauccuagaagcugcaaauugcuggcuuguggaugucuuugguuuggccugcugaaguuuguuuuggauuuuuuaaugaaauaaauuagcugugaacauuuaaaacuugggagacaucccaucaaaauugggauuuccugcuuaucucgacaaagcagaucuggcauccuuugccugcauuuuacauuuggcuacaguuggcuggacuugagcagcggcugccccucuuuagcuggggcaugugcccugugguuugccauaguacccaucaggccugcuucacucauuguagaaauggccuggccuccuaggcauuggagauuucuguuaugcucauucaugagcuugccugcuuacaccuagcuguuguguugguucucauaggucucccugauuccagccuccaauucacugagcuggccucugccagugucacuucuccccagucuuggcuuugaucaagcuuggaaaggccuggccuuuguguugucacauucuucugccuagaguaugccuuuuccuucaccaaaccaaguggcucuuucggaagacuugccugaauccuagaccccuucucucuacaaccuucagucugaguuggguaccuugcauccuccuuuguucccauacuaaccccuacaaccauggucauuuugugguuaucuguuuaauucucugcuggcuauuccaggcugucagcucccugacuacaaggacuuuguugcucacaaucauauccacggcauccacacaagaucuggccgcuacguggaaggacacauaguuccgucuggcuuggagccuagcuugggagagggacaguaguggggaagggugagcuuggagauagagcugaccuucccaggugcuucagcaguuacagcaagauucuagaucuuacccugacagucacagaaagcacugggagcguuuaugaauguugugguaucucacauaauaaggggaccaugcauguauuuuagaaagagcccucuggcuucagggaagaacgauggauuugugagggucaggacugguagcaggugggcuccuagaauagucccggcaagagaucauggaggccagagccagggauggauauagacuaagacaugccuguagacugagugucgaggagcaaguagaucaaauucuagcaugagacugggagaaagagauguucuccagccaauggauuuaugaaaugaaugaacuuuuucccuuuccucccaagcauugccuggaucaccuuguuaauaugguuucuuauuaaacgugcuggaaaaaagaggcucuaagugcguaugcuuuuaaagcaacacuauuagcaaauggccacuggcuucauuuuuccugugcauauauuuuuguguauuccgggaggauuuucuuuucuuuuucuuuuuaauccuccuccucaagggaaacauucuucucacaauagcuuccugguagaaaguucuaacuaaugacuuuaaucgugugaauguauugcagaaauggacaggacaauucucagcccauucaucuuacagaccucaagugaacaggcacaaaacaacaggcuccacccuccuuccccccucuaucucauacuuuaccucaauuuaugacuuggcuuacaauccguugcagaaagccuagcuccccagcuucuccugaaucuacguuuuucuauuuugucugaacuagccaaggucucuggaguuugcuguuauauugcuucagagaaauuagugacauugaaaggcuguugucuuuuuuaguguacuuuugguuguuaggagaaauuuacaaggccauuuuuuucucccgucucugcaguucaggagauuauauuagaaaauauucuauacaaaaaauaugcauaguagggcuuuucuccagcuaguagcucagaauaagucaguacuacugaaacagguaccuuuuguggaauugauucugaaaucuguuuggaucugaaaucuuucuuucuugccuuugaguaagauacggcagagaaaaacaauuacacuagcugcuggucuguauuuacugguuagaauagaauauuauuaccaucaagaauaacauuaguggccaggugcgguggcucacgccuguaaucccagcacuuugggaggccgagguggguggaucaccugaggucaggaguucaaaaccagccuggccaacauggugaaacccccgucucuacuaaaaauacaaaaauuagccggguguggcggugcaugccuguaaucccagcuacuugggaggcugaggcaggagaaucccuugaaccugggagguggagguugcagugagcugagaucacgccauuauacuccagucuaggcaacaagagugaaacucugucucaaaaaaauuaaugauaauaauguuacaauaauaauaauguuagugauacauaucauuuugaaaccaguucuuaagcaauuaaaaaaaagcagcuauggugauugaguuuuuguguuaugaauuuuauacucugaaggcauggucauugugaaugccaaagaaaugaacaggagaaaauuuuauuugaaagcugggauuguugcaugcugcagaauuuuuuuuucuuuugcuauugcuguguaacaaaugaccacacacuuagcaguucacauucacaucuuguuuauuaacuacaauucucuagaucagaagccuagacacaaugugacuggcuucucugcucagggucucuuggggacaaaauaaagguguccgcuggaggaacauccuuuccugcaugcucuguggaagaauccacugccaagcucauucaggaugcuggcaggauucagauccuugaaguuguaagacuagggccccuguuuccuacugacuucugcugguggcugcccucagcucccagaggcaacccacauuccuugacuuuuggcccccugcaucucaaagccagcaacagaaacucucuugugcauggaguccccuccugcuuugaaucucucugacuuuccuugacuuugaugucuaggucuggauuucaagggcucagaaacucucucaugcauguaguucccuccugcuuugaaucucucugacuuuccuugauuuugaugucuaggucuggauuucaagggcucacgugaugaggauaguuucuuuaucuuaagggcaacugauguggagucuuaauuaacacuggcaaaaucccuucaugacaguaccuagaguaugaauugacucaguaacuggaagaaugcaugcguacaccauggaccgggaauccgggaggccaauuuagaauuuuauguaucaaagccccauuuuuuuuugaauaacagaaaaaaaaaagagaccugauauuuggagagacuuuuucaaaagcagaaaguuuaauauaaaagaaaggggguaauugaagaagauauaaacugcaaagaaaggauguuagguagagcgccuuauagggaaucagagguuuuauuacaggcagacacggcuucaccugugagccgagcaagugauuuugccugcagagaagaacgcaggguuccuucuauggcucaggaucuucaguuaccagcaguggaagugaauugaaaauaguuggucucuugagugaccugaugcaacucauuaucuucucugugccuuaacgucucuaucuaauuucccauuaaaaguaacaggaaaaagcgcaaugacuuuugcaccaaccuaacaauggguugacauucaggauugcuauaaugaugaagcaauggcaaauggagucuuuguuuuuagccccguggaggcauaugcugggcacucaacaaacaucacuuccccugcccuuuucucagauagaguuauccaaacaaauuggaugcucaacucuggauuugauccaagcucucuggaaaucucuagcuucucaaacuguuucgugguggagugccuuuugggcacaggagaaggaaauaagagccucgcgagguuugggaaugcugccucuagcucucacacugcaugcagaauuccuacucugagagcucacuuuaucucaaaaacccaugcauauucugcaucuacucugaauuccgcaguguuguguguuacuauacgaucuaguguuuucguugcuuacaaguuagauucacacuccaggaauguaucuguucccacauccccugaugcugagcauaccagaguuaagggaggcaagcaaggccccuaaccucccagguucauggagguacccauucugcacuuguugaccuugagcuugaggacuccauaaaugucugcccuuggcauugcacgugccucccucugggcugacccugcugggccugucacuuacucccauuggagaggccuguuuccauacauagcucuuugucaguugcucacacucggucaauacuugccuuccuuugaggccaucugcacucacugacaaucugaucgcuccccugaauggaggugaaagcaugcaagcuaggaguuaagaucuuuaacucagggaagacccugucuauggaagugcugagcucuucagugucaucacagaaaagcaugagccccucccugguacggagucaucacaucccauagcugagcgacgucggagcuccacgauggggaggugacacauagucaguuaauuacauaaagagaacuugagcaaacucuuacucugccauaugcugugcagaucccucugaaaagcuuuacagauguucuuuuuuuuuuuuaaucccucccccuaucuuucuuucuuugcacccacgaugcucugcacuucaagcuaaauauaauguaucugauuuuacagcauacauacuaaucagguuugaaaguugucuugugaggcuuuaaaaagcuagccaagagcagugcgauuucuccaaaaggaugucugcaaucaagaugauuacaugggaaaauaaaucauaauuuauauugcugaaaaugucauuugcaaaacacuuugacaauacuuuccuuucagucuauuuuccuguguaugggguaaguguugcccuucugcaacuuuccuuuuauuuuauuuauuuauuucuuuucaauacucugaauaucacuggagcagcugcagauucagggcaguauggggugguucaggaacagaacugacagguauugaagccaaaaauugaacaauaacaacguaggagggagaauccaaagauaguauguguucaggauacgggcacucgugugggugaacacacacacacacacacacacacacgcuuuuuuuuuuuuuucuuuuuuuuuuucuccuauugcaauagaacguaaagguagauuuuuagaaccaaaugccuuuuaggaagcuaccucucuuccacccugcugccuuuguguugaauaaacuauauuaaauuauccaggaggaaugauuagugaucugauucauuaauaucccuuguuauuaagaacugucuguauuuguguccugguuggcagauauuaaguccacagauaccaauaauuaauaucuaugguugauuguaaaaauggccaccaauucuucccuguccccugcauauguacauccuugcacugugaaauuguagaucucgcccuccaaaggugaaguucguuuguccacuccuugaaccaggauggcaugaaacuugauuugaccaaugaggcauuuggaaacacggcacaagcaaaggcuugaaacgugcuuuuauguuggugcuugcccacuugcugugcuacgaacccuuuuacuucugggugcgaacaagcccaggcuagccuucugggcgaugagagacacaagaccauguuuccauauugccccagccaagagccaaccuacagacgcaacugccuugcugacagcagacaccugcccagcugagcccagcccaaauugcugacucaugcaaucuugagcuaaaaauaaguagcuguuguuuauagccacuaauauuugugaugguucauugcacagcaaaauugaauggagacaauacuuuugaaauugacucuucgggagcuguuguaaagaaguaaaauguguaguguuugcccuuuuccucagcuguaggccugguaugcagaaguauucaguuauuuggugagugaacccucgcugaugcccuggcuaguguuuucugucucaggaagcaugaacauuucauccaggguuauaugcuacagggauauucaagaaauugaagauccuugaaaaucuagucucccucacaaggaucagguggcaggaucuaaugggagggguagagagugaguguuaacacacagagaacccaggagaccuuucucagaggucucauaucaagaaaagaucauuucuccuaagcaaucaauuucuuuuuaaaucugaaccucauaucugagaauauucccuucuuuuaucuggccacucgggagcucaaaaauaaauuucuggcacccuucuuccuggcuccaguaaagucauacaaccauaugguaccucucuggcaacuaauuucaccuauuuccuuauuuguuuaaaaauuuuaacuuaaauuuuuuccccucaagaucuauuuacggaucaucaguuuuauuuuuucuuuucuuuccucuuuuucuuuugcucccuuuucuccccacucuugacucuucucuaguuuuuauaugcaguuuguauuuauccaugccaucugaaauccuccuuccuuuuuaacaagacaaguagaaaacgaaaacaacaucaaaggauacacuacacaauuguuggagcccuaggaaccgagagaagaguacaagcagguucuugaacuguucucuccccagcaacuauaacuggaaggaaccucaguuuguccauucauucauucaucagagcagcauagcagaguagaaggaacucugacuuuggcauuggugccucuaaguuugaagucuaacuccaucacuguguuucuuuccucuugcugauagcugauuuguuauaaacaaauuaccaaaaacguacuggcuuuaaacaacacaugcuuaucauguugcaguucuggggagucacaaguucaaaaucagucucaccuggucaagaugucaguagggcuuguuccuucuggaggcucuaggggagaaucuguuuccuugcguuuuucaucuucuagaggccuccugcauuccuuggcucuuggccccuuccucuggcuucaaaccagcaguuuaauaucaucacaucuccuuuacugauuccucuuccguugucccaucacauucuccucaucuggcccucuggccacucucuuauaaggacccuuuugauuucauugggaauacccagauaaucuuggauaaucacuccaucucaggguccuuaaucacaucuucagaguccccuuugccauggcugaugacagagucacaaauuuggggaauuaguguguagacuucucuuguagggagucauuauuacucuaccacaaccacuaauucuggacuucacguucccucauccauagagcagggauaacaauauccuccaggcuauccgcggaaguagagaauauaagcuuuauccagggggccacucagugaugggagucuuccuuaugaagcugucccagcuccaucucucaggacugaaauguggguaagaccaucacauuuuucaucccccgccccccgcccccaacauugacugggcagauauucauacaauggcgauuguuuugucugccuggauggcuuuaacauaauaccauagacugggcagguuaaacagcagaccucuauuccucacagucuagaggcugggaaguccaaggugaagccaugggcacauucugugccugccugaggcucucuuucugguucccagauggaugccuuuguguguccucucauggcagagagaggaaggggucuggaaccuuucucuuauaaggauacuaaucccaucguaccccgucccccaugaucucauuugaaauuagucaccucccaaagccccaccuccaaguacugucacacuggggcauagggcuucagcauaugaauuugggggagcuggggagaggaacacauacauuuaguccauaacaacuaucucacuuaccucucuacuaagugauucagaaaauagcaaguauaguagugggagaacaugguaucagaaccaggagaggguccucuggcuuucugaguucugccaaaaaccaaguuuugcugccuugggccuguggcuucuccucccugauugucgcuggccuugcuguaaauugugaggcauccaugugaggcacaggaugguuccaaggaccaacugaggcugucugugcugaggcugggaggguguaagugcucagaggcagccggaagcugugguuuuuaccucccaagacugugcagagcuuccuucuucuguagggagaagucucucaggacagggcucacaacagugcagucaggagauuggaaauuuuagugacaccaaagugggcuuuacuuccuccuccuagaauuccugccagaaagguggagaugugcaauaaacugagcaccgauagaguaccaagaacaugcuuuuugcacauuguuugauucaucaaucagaguggggcauggcugucaucaguucagaguugaaagaauugaagaucaaaggggucacgucucugugaauaguauuaguaauagcagcaguaucgauagcaaucauaguaauuaaaauggaagcaaccaccaguguaaucauagcagaaacucacaugugugugcuuucuaugugccaggcaugaggcugaagucauacauucauuauuuguuaaucccacccuaagugauagguguauucaucauucucaguaucagaagaagaaacugagguucagaaugacccaguaaagaucacaagcccaacccuggugaagggcgugauuggcagaagcccaauuuaagcccccaucauguccugacgcuuucccaaagcugagcugccugccagggucuuugcucuuccacugccaagaaguaagguuuugguugggcgcgguggcucacgccuguaaucccagcacuuugggaggccgagguggguggaucacgaggucaggagaucgagaccauccugguuaacaccguaaaaccccgucucuacuaaaaauacaaaaaaaaaaaaaauuagcccggcgugguggcgggugccuguagucccagcuacuccggaggcugagacaggagaaugucaugaacccgggaggcggagcuugcagugagcagagauugcagcacugcacuccagccugggcgacagaaggagacuccgucucaaaaaaaaaaaaaaaaaaaaaaagaagugaguuuuuuuuguguauucugaaagguucccaagcucgccgcagccugcuauuguauuuaaagggugcccuuugcugcguaacuagggcaaagaagaaccaacuggcuguuccccacuggcuguggagaguuccagcucauccacccugccucuguggcugagucggggagaaaaggacaaaguuuuucucccgcaacugggccaccaaaccagcagagccuccagccgggguggucucgaggaggcccauuaccggcuggagugacagagugugucaagccugcagcucgucccgugucuaauggaacagaaacaagcacccugcugcccuuguuuuccaguggcucaccggggcucugcgagguuuauuaaucuuagcguauaauggaaaauguguugccaugugaaaucuagagccucuguucacuacuccgcgaauugaaggcggcaggagucuuugucucauuuacacacagugccugcgagagacucuuagggcagaagaacgccgucguaaaaauccgugcggaauuugaaagugugcauuaaugcaugugaccagaugguucuaaaauaugccacuuucaccaaaaaucauccucugaaaaacucuucugaacaacaucggcugugcauaguaacugccuugaguggggccauuuuagaaaauauaugagguacgggaugaagaugagggaggaaaaugguuccuacuuaucauuacuuugucccuccaaaagccugcaugcgggaagaaaaauccacccagugcaagaaccguggcaguacucagaccauuuagaaucacuuugaguuauuaccaagaaauugcuaaccacugcuuuccaaguuauauauuaaauuuuucuuuuuuuuaaaaaaaagcuuccaacuuuuuuuuuuuuuuuuuuugaguuggagucgcacucuuucacccaggcuggagugcaguggcccgauccugggucacugcaaccucugccuccuggauucaagcgaguuuccugccuuagccucccgaguagcugggauuacaggcacccgccgccacacccagcugauuuuuguauuuuaguagaggugggguuucgccauguuggccaggcuggugucgauuuccugaccuugagugaucuaccugccucggccucccaaagugcugggauugcaggcaugagccacagcguccagccccaacuucuuaaaagccagaaacaacuggcuguuagcugucacaauauuaauacuagugugugcaaguaaguuuguuuucugcuucugucuuacacguuuuacgggcuaucaguagaugcaucuaauaauccuaacacugucauccuuauacuugaggucuuauuguccacuucuaccuuagcuauguaaacagaugaguaaccuacucuggauuuacccagauagugcuguuaggcaccacacacgaugagauuggaggcaccugggugucagccucuugggcuggcucauuacaggccacucugucugaggaacacucagguuugcaaaccguuucuuaaaauuacaggauaccuagggaccuguuggggugggagggaagaacccuaugggcagaaaugugacuuucuguagcaaagauguacuguuucccacugagaagaaucaaaaauagaaaagugcuuccuugucucucuauauuguuauuaaaacaaguagaugcauuuucauugaaucaaggcaguuuuccuuuauaaaauguccuauuucauaucacuguucaaacuugacauccacauuugaguugguuuaaaauaucacuguuuuguugacauucaccuguauuauacauuucaguuggucaagucauuuaauuuaucauaaaccauuuaaggagcaguuggagaaaagggggaaaaaguuaaauguuaaugauucuuuucguaacugcaauuuuaucggcuccuuuuuguacauauaugauuaugaagcaauuugcaugaaauuuacaccuuuucaaauuuugaaaauugccuuguugaaaaagaaucgcuguacuucucaauacuacacugauuaaucacaguuauagaguagacauaacauuuuuauuaaacucucagugagcaggaaaauuagcacuuccugcaauaacgauacuaauuucauuagugaacguuuucauuuauaaagugcuucuuccuuaucuugaaccuuuuauccucuucuuauugaccaaagagagggcauaucuuugggagcugcuaauaaaccauauucguaauaugaugugaccucaucgacaggcugcugcuucuagcucaucaucuuccuugaucauaaauacccaucgguaccucuugucacauggugcucuuagagcuuccucuuugaauuucacaugugauaagagaugguuuccauccugaagagcuugcagugggaugguuaucggaaagauuaaaacucuaaaacuaacagguggauauaaauauaaagaaaauacaguauuuuguugauuuauguucauauaacuucuuuauugguaaaagggagacaggugagaauacaggaaauccuuguggccuuguuugccuuuuuuagaaauuuaacuuugcaaacaaacucaggggaaacuagugagguggaaauaaagaaugcuagacuacgggucuggggcccaaguguuuuauuaauauaaaaacuugcguauaaauguccaguuucaccaccaaauccuuucugaaacauugguaguagaugaacuaaugcaacaauuuauuuuucuuugagacaggaucuggagugugguggugcaaucauaacucacugcagccucggucuccugggcugaagcgauccucaugccuuagucucccgaguagcugggauuacaggcauacaccaccaugccugccuaauuuuuuuuaauuuuucuuuuauagagaugcaguaucgcuuguugcucaggcuggucucauaugccuggacucaagugauccucccgccucugccucucaaaguacagggauuauaggugugagccacgaagcccagcugcugcaguuacucaaccagcuuccuacuagaagccaggcguuucucaagcuucugaagacacaaaggugaaccccagacaagccagguuuacagagugugcauuucagugggggagccagccaaaaaaucaguaaacaccaagauaaaauauauuccaguggcgauacauuuucagaaacaaacaaacauggcacugggcuggaaaugaauggcaggggagaaggcgggcggggcaagcuuuggaaagcacgggcagguaaggacaggguuucaaaggugagaaggagcuggcagugugaauagccaggggaaaaguguuuuggguagaaggaacagaaagugaaacggugcccuggcaaggcaaagauuauucauugcugaagagacuauguugcccagaugacuuguucauguaaucugugauuuuuaaauuuagaauugagguuugaagggaaguauugcuccuuucuuuaucugcaaugggaaagcuuacuguaguuacuuacaguagaagagaaauguacauuucugaaaauccacugaggaagaaaggggcagugaugauucuaaauguuaauaaugcagacagccuuugcuuuauguaucaauuuuuguaaauguguugcuuaaauagauuuuuaugagccaguaaugguuuagaaagguaaaugacuugcccaaggucauacacccaguacacuugggagccaaaauucaucauagaugacuuugugaaaugucccauuaaauguguauauauauauauagugugcauuacagcuuaacagacacacauucauuugacacauuauguuuuaacuuuauuaauaaguuuuugugggcauaggucuuguuuugccaacuugacauguggauuuuaaagggcaagugccuuagaauacaaacuguccuauaaagaauaccauauuaucgaaaggauguucaaacucaucaguuagaggcguugcaguuggcugggugcaguggcucacaccuguuaucuccgcacuuaaggaguccaaggcagguggauuacuugaggucagaagcuccagaccagccuggccaacauggugaaaccccuucucuacuaaaaauagaaaauuagccaggcguggugguaugugacugcaaucccagcuacucgggagggugaagcaggagaaucgcuggaacccgggagacagguuguagugagcugagaugucgccacuauacucuagccugggcaacagagcuagauuccaucucaaaaaaaggcauugcuguuaauacaacaaugauaaguuauuucacacucaccagauuggcaaaacguuaaguacuaaggucauaacaagcacuggaaggauguggagaaauagggaauuuuaugcauuacugaacugaaacagccauuuuggaaaauauuuugguauuacguaauaaaguaguacuuagcaacuuaugcaauuugguuccuauaaagaugccuuagagaaacuguugagaacuaggaaaagcucaggaauguuucuggugcauaauuugugauagcaagaaccugaaaguccuccaaaagccgucuacaaugaaauggggaaauuaaugguggcacauuccugcauaggagauagcagugauaauggguggauaccagaacgugcaucaacacagaagaaucucagcaacauaauucaggauuaaaacagcguuuacagcugggcacaguggcccacaccuguaaugccagcacuuuggaaggccacagucggcagauggcuugagcccaggaguuugauuccaacccgggcaacauacugagaccccaucucuacuaaaaauacaaaaauuagccagugugguaucaugugucuguggucucaggggucucagguacuugggagacugaggagggaggaccucuugagccgggaaggucgaggcugcagugagccaugauuguaccacugcacuccagccugggcuacagaguaagacucugucucaaaaaaaaaaaaaaaaaaaaaaaagcauuuacauaggagaauauauacaguaugauucaauuuauagaaagcuuaaaguauaggcaaagcuaaacauucaggauauuugauaaaacuauaaagaaaaccaagggaaugaagaaugcaaaauaugagcuaguguuuucccaggugugagggacggggcaugguugggaggaaaacagaauggugccauggcgagagauacacaggggagguauuggaaaguucuguuucuuaaaaugagugacagguaccuagguagucauucuauauguuauuaaaguguacacacauugcuuaugugaagucuuguuauauguggcacauaucacauaaucugaaagaaucugcuuccuguaguaaaaauuaaaaaaauuauagccgggcacgguggcucacgccuguaaucccagcacuuugggaggccaaggcaggcggaucacgaggucaggagagagaccacccuggcuaacaugaugaaaccccgucuguaccaaaaauacaaaaaauuagccaggcaugguggcggggugccuguagucccagcugcucaggaggcugaggcaggagaauggcgugaacccaggaggcagagcuugcagugagccgagaucgugccacugcacuccagccugggcaacacagcgugacuccaucucaaaacaaacaaacaaaacaaaacaaaaaagguuuaagaaauguucuaguaccuugaaaccaaaauagguaucagauacuuggcuguuuuguuuuuucuucuuagccauuuugaccugugagauuuuaugugaugaaaacauaagaaugugguauuacacccugugauuugaauuuuccauacuccauuccauucuauaugucagaugcaucuuccuaaaacacaccuuugucacaucacuccucugcucaaaaacauucaguggcucccugggcccucugggacuaaguuuauaaugcucagcuugucauuccuuugcccaguguacucucugucucacuaauuuguucauuauuuuaaugcauuuucuugaauacacuucuguagacagccauaagauggguagcaggaaugcugcacugaaccauaauccaaagcuuucaucagguucacuugcuuccuguccuugccacaccaucugcucauucucgaucuccacuugaacacacuucacauucuccacuuguguaucauucacuauucuugcuacauaaauuaacacaaauuuugcagcuuaaaacagcacacauuuauuauuucaugguuucuguggaucaggaaucugaguaucagacuuagcuggguccucugccuaggguuucacaaaguugcaaucauauauuggccaggguguguucuaauuugguagcuugacuggggaagaauuggcuucccaaaucacccagauuacuagcagacuuuauuuccuuguagcuuuuugacucggccuggcuucuugcugacuguuggcuguuggcuggagguaccccucagcuccuagaggcaucaacaguuccugaauaucugggcuuuucccacaaagcagcuuccuucaucaagccagcaacaagaguuucuggggcaaguuggucaacaagauggugucuuacaugcccaauguaaucauggaagccauguauaccucaucacauuugccagauuucugcugauuaauaccaagucagaaguccugcacacauucaaagggaggacacugcacaauggugugaauaccaggugguagggauuauguggggccaccuuacagucuaucagccacaacuugaaguaucuucucuccucuuugcugccaaauaaugucucugaagacuguaagaccugaauccuaucuaaaguugucggugguugcuuccuuccugaaagcaacaagaagcccaugaaugucuuauggccugaagaucugccuucaaagacuacuaccuguguugucacaaauggcaagauuucauccuuuuuauggcugaauaauauuucacuguauaugugaaccacauuuuuaaaaaugcauuucugaaccugaaggacauuauguuaagucaaauaagccagacacagacagacaaagacauaugaucugacuaacaauguggaaucugaaaaaaccaagcucauagaauagaaacagagagugagaauggugguugcuggggcuagggggucagugaaguggggagguguugaucuaaggguucaaacuucucguuaauaauaaaccaguucuggagaucuaauguacagcaugaguggugauggauguguuaauuaauucgauugugauaaucauuacacaauguauauaguaaucaaaucauuacuuuauagacccugaauauauucaauauuuauuuuucaauuauauauauauauauauauauaaauauauauauauauauauauauauauauauauauauauauauauauauauauauauauauauauauauauauauuuaaagcugucauggaaagccuuaaaguuaaaauacgaagauuuuugagaaaaacuuugcauauuuuaauugcugucuggaauccuccuucagcugggaugagaaaccaucucuggguuaguucugucccuggaggugagggccagacaacacaucaaaacugacuuuuuauuuuuuuucaaaguuguuaagacuaucuaagauucagaucucccuaauacuguuccuaguuaguauuuagaacguauuuguuuagaggauacuagccugaaauagcccuaucuccagguugucugaugcgaugaggaugugguguuaaucuuacaccuacccauuagucuauaaaacuccugagggaugcucaggaaaccaaaaaggaugucugcauggaggacaagaaggcacaaaucgucugauuucaccccauccuaagaucuugugacuucagcuuuguuuuggacuggggcauuggaucucccacaugcccucucuuaagucgugcauuugacgcauauuuaauaagcaccuacugugugccauuagagaccaugauacaguuuugaaagccuagccugaauaauggaugacacccuccuaaagccacgauuuggucuugauuauuuuuagcacuaugaagaaaaauuucauuaaaucacaacucuauuuacuuuuaacccaacauggugaaguuaucaacauauaaugccugucuauacuuucagauggaaaaugccuagauaaauacugcaugggacauuuuuaaacauguaaaaaaaucaauuuucguaagguuacaucuuuuuaccucuuuauauaaaacaugcuauauuaaaagagagauuaaauuuuacccuguggaguaaaaugcaaacacaaaauuauuuuuuucauuuuucagagcauguacuggauuaucauuuauuuaugaggcuuuuuuuaaucuagaauauauggaaaucuuuucuugaagcacaauauaauauugaauugggaauguugucugacaguuucccucuuaccguugcauagaaugacucuccuguaugaauuuuuaaaagaaacuucaauaugcuaugcauuugaaagggaagaaguaaucaccauaaucuugagguaucuuuuaaauaggcuuccuuccaguucuucuauguuucaccaacuuuucuacaacaaauaaugcaucugugauuuuucagaacucacaaaauguccagcuuucuuucuuuuauucaaaauuuauacuucauaauugaaguucaccucccaaaagacauagcuugguuuagcauagagcuaugauguguuuucucuuuguuccuuuugcacacuuuccuugucuggaggcguugggcuuggauccuucauucuucaugaggcugauguuuuuccauuucgguuuccuuaaguggugaagcugcacaaccaugaaagcagugaccacauaaaaaugcugcuuugaggccugguaccucaugccuauaauccuagcacauuggauggcccaggcaggagcaucacuugaggccagaaguuugugaccagccugggcacuauagugagacccugucucuacucacauaaaaauauuagcugggcaugauggcucauagguguagucccagcuacucaagaggcuaaagggggauauuucuuaagcccagaagauucagacugcaaugagcuaugauugugccacugcacuucagccuaggcaacacaacaagacccugucccuuaaaauaaaugcugccuuggguaucuuaauccuuucucaagauuccuucuaaggcuaacauuucuuugccauccccacacuaccaucugcucacuuuuauauaucuugaccauuuuauuuuucaucccaucuucacuccauguaauuaguuagcuauugcugcagaacaaaucaccccaaaauucagugauuaguuuauagguagccccauuucacccaucucauucuauagcucagguugaaaguugagucaugaauuggggaacauucuucucuugguguaaauuagucaccagugucucauaggguugggcugaaacuuaacacaucccaucacuuugauuggcuaaagucaguuacauaaccaagcccagcuucagaagggaaauuguaugccuuacaaggaggugagaggauggaaaaugaauauuugcugaacagacuuucuguccaguuuguuguauuuggugguggugcagggcaaauauauguuuaaaaccuuguucagauuuuuagcuuucuucagaacagagcuuuuaaaacugagcauuuguccccuaaauuccagcacugcggccaugaguaaagggugcccugaccacgagcaaaucauuuagcuggcucaccuuucaugcaaccuugaauucaccaggaaggaaguucaugcagcccuggguaugaugcccuaauuuugagccaagccagcuagaguucaaguccaaaccauuccacuuccuagcuuugggacgaugaacaauuuacuuaugcuuucugggcuuugguuccuaaauuauuuaaauggggaugauuacauacauucaucauuuucaccuucucaaagaccuucuggacaauuccccaauucauagcucugggagacaguguguugacacucuauuugaccacaucuuccuagcagucuugcggaaggugccacuuugcgaacgaucuguugcuagguaaugucaaugacaugacuuucaguuuagcacauguacagaugaccuuguuugggcuugugccguugguaauucaguuucaggauuuccguuugacagaauauauucaagggugguuucuugcuaucaguuguacccuuguggccacaguuuuuccagauaaccaagacucacuaauauuuucacaagaacauuugucaccuagguccagauuucagaggaaaaaaguauaccgccauuguucuuguauaaacuuuauaaaauauuuggggaacaucacuagccaccugcuuccgaaaguacuuagauacugugucaucuuaauacaagacacuaugcacuaauuaagcuguuguugaugcuuuuuugccuuuuugacaauuaaaaauaaucucauaccacuggauuagucucuugccuuucaauuuuauguuuauauacaaauauaugugcauaccaaauuuuauauauauauauauauauauauauauauauuuuuuuuuuuuuuuuuuuuuuuuggucggagucucacccuuucacccaggcuggagugcaguggcgcaaucucggcucacugcaagcuccgccucccggguucacgccauucuccugccucagccuccugaguagcuggcacuauaggcgcccaccaccaugccuggcuaauuuuauguauuuuuaauagagacaggguuucaccauguuaucaggauggucucaaucuccuggccucgugauucaccugccuuggccucccaaagugcugggauuacaggcgugagccaccgcggcuggcgaaaauuauauauuauacacacaaacauacacacacgcacacaccaaauuuaaaaagacagauacauaggcaguuguuaugcaguguuugaaauaaauuuauugccagcuaugggucauuuggaaaaagaucaauaugaugcaucaacauaacaaguaaauggaaaugaauacaaccgcaugguuuucugaaagcacgguuuccugcgcggcuuccagaauugcaucccugacauuuggaacauguguuacaugcuacagaacaucugucugugaacagguuaaugggaaaggugcaucucuacaaacaaauauuaccuguaaugcuguuguagcuuuguugauuguugauauuacuuaugaacuuucuugcuuuucagaaaccaccaccacaaaagaggcaguaacauuaguauuacauuauacaucuuaggcauuuuuuuccuuugcccuuuucguagguuuuuguuuguuuguuuuuucuugucagccacuucaucauguuuggucucucgucuuuggcuguguuuuucuguuucuaguuauuguggguguuaaaaaucacuuuaaugauucagcaauaauuaggaagucccuauuuguggguguuacuuuacuaacuaccagggaugaaaaggcagguuuugcuuuguuauuacgucacaguuucgucaaggagauaaguacuuaaauugcaguagagugugacagcauaugucgacggugugagugauauggaauaagagugagacagggaggcagggcaggcuccaaaggcgaagagaugucugagccaaauugaaggguaaacugaguucaccaggcaaacugaggaaggguacucaggcugaaggaucaugggaggggaggagcgugaguuccucuuaagugaauauaaaccaggggguaggaaacaacaugagaugaggcuggcgagagagaaggaugcuaggugaggugcuguggugcgccagagacugcggaaguggcuuucuaauuaagaaacagaagccaggaaacuccuguacuucaagguuuuggagugggaaaguugaggaaauguaagagaucaucucugucucuaucacauuaccgacggagaagugggauaagaacuauguguguuuucacuucuucuuucuuuagagaaaacaaauaucaucugccuugcuagguaguugugagaaaugaggagauaauaucuuuaaaucuccuacggugauaccuggaacaugauggugcuugggaaaugucucuucuucugaaaugaggcugccucgaagacucacuggaacccaagcaaagugucucugcauuucacuccgagccaucgacuucuguucugaauguuaaaaugcagguggcugugagggagucuucugagucaugccagcguuuaaggcgcuugcucuucuuugugcacauuccugcuuuucucaaagccuauugaaagcaagggccauguuugcuguuuucuuugacagaggaaauuuuuuuuuuuuuuuugagaccgagucuugcucugucacccaggcuggagugcaguggugcaaucucggcucacugcaaccuccaccucccaaguucaagugauucuccugccucagccucuugaguaggugggacuauaggugugugccagcaugcccggcuagcuuuuguauuuuuaguagagauggggucucacuauguugcccaggcugaccucaaacuccugcaguacaguauugcaccuuccucggccucccaaaguauuggaauauccggugugagccacugcaccuggccuccaacagaggauuucagucaaugcugagcaccaauuacagauugauugccucugugauuccagguaaauaaccuuguuguggagcugagucuuucaucaaaaacaaggacuccuggcagaugcccagaggcauuuauaagcagucccaucacgaacaaauugccaaaugcaaggccugaacaaaagacacagaaaggauuucuuuaucguaagcacacuucucuacauuaccuuuacaauccaacaacucugguauuaguaaauuauagaaacaacuuuuguaacacuaucuuguuugcagaguauaugaaaaauuugaaguuaaaauucagcuccacgaauacugcaguggugagaaaauggcgacaaagauuagucuucugugagaagucugcuaauuauucuucauuuaauaaugccauguaugauggccuucauuagaaugaauucuucucaacaccuaugccucuuucaccucagacaugccuucuaauuuucuuugguagugucugcccacccaggugguaauuucuggucauaagucuaauuuaguagccagcuaaaggauaucugugaacccuucgcaaagaguaaucuauugaaaaggaacaacaaaaaaguauaucugugaacuuauuaaaugacuuuaaucauaugaaaaucagccaucagccuuauuagagugguugauuuuuuuuuuaaucuaagagcuuucuugguuauuuucuguucuuaaucauuguuguauauccuuaaugcgcaggacaugacaccguauaacaaguguuuuaaaaauauuuacaauucugaucuuauaaaggaaaaaguuacauaugguccuuugaacuaauugcuaaaaugacacuacauuaauuagauaauuaagggucuugagcauguggcuauuguauucauugggcuggaagccaaccuuuucuauagcugagaaaauggguuagcauaauucaaaauucaauugcuguacccuuuuucauaugaauagauaauacagaaugagccuuaaaucuggguuggaaaaacuaacaggaacugguuuuauuuuaauugaguuuuaaagcacuucuaggccaucucauugucuuuauaguuuaacccuuugaaguugugacugccaacgugcuagucuugucgucuuacacguuaaugguaaugaucuuuuuagauuuauugugaaccucuaggaauguuuuuuuuaaccaguaaaugcacugaaacauggaaucaaagucucuuucccgugggccccuuuucauugggaauaaaugcuacccauagauugaaguaguuuauaccaguacauuuuuuaggugccuuaacuuaccaagguuauuugucaggaaaauuaucucuuguaacaccagguucccuaccuuuagaugacaggacuuaauacaaaaguuuuccccauaccaacuaguaguguaaguugauuucauauccuuuuauuucauaaaguuuugcuuaucggguuugucauccucuauuugaaauuaaaauguguggucucgagaugaccuuaaaguaucugacccccaaaucuaaucacuccuagcaucugugaaaauugacaaauaugucagguauaacuuggggcaucaaaacauuguuuuaaauauuucguuuguagacaaggcaaagaucauuuucagguuaguccucugagaaggaacgcugggugcagaagcaucuuugguuucucugcucuauaaucggcacucauuaucuauggguuuauacgagcagaaaauguacaguuauauguucagcacaagugaauuauugauuggauuuacggccagaagaauguuccuaaguggucaauacauggccaaagugugucaggugaagguaaaaaucaaguaagaucuauacuuuugauagcaauugcuguuggauuauguuacgcuugucaucugagguuacuguugaauauagauaaaaauguuaauuguauuaauuuagacaagaauguggcuucaaugaguauuucuuacaaagugggaguaucaauuuuucuuaaauguagagauuuaguuuuucaaaaauuauauuuuuuauaugaccugacguugauuggcuugccuacauucucuuuugguguaugaugacaguuuaaaaauucggaugcauuuugcacagaauuaagacguuaugugcaauccuuguguuucuaauuauauguugaucaaugacaccuuuacaaaacugucaucagucuauuggugguugauugguccaaccuuagcccgauaccucuaucuccgcuuagucauuccuggugggugacugaugaccccugcuuaacaguaaacuuguuaugcauaggguuguuagaaaagucuucaucaauuugagccaaacuguggcucccagcuacuuccaucagggguccuuauuccacccuuugauugcaaaaugcccugaagaccugguaugucuuaugucaguuacaagaggcccuucuagugauguaccgggaaccuccuaugggaaccagagcucugcuaauuuuggggacaagaaaugaugaaaagaagugccuuguucuuggggcaucacagucucaugacagagugcauguugucaaaugcgcguuuaaucuucuuaagcucaacuucaugcaagagaccuaggaauucacagagugaagaugauuucuccauucccuucuccgagcagagcucuugaagaagaugggaguuaggagaagugaaucuuuuguuuucgaagccuuuguccuugugagucucuuaauuggggugucuuguaaugcaaagucuuuaaagauguguguuccugaaacucaggaggcugcucuaucccaugguucaaccaaagaaccagggccaaagcagugcugaaggaacaacugauucucuuggcccuccuuagagugaggguacaacuggcuccaaaggaaauguuggcacuuccagaguaauucugacaguacucagauuugcuucauguacccauucuagaaccuuaccuacucaaguguaagaugagaugccacugugguaucuucaaaggaauuuagaaucaugucuuaauggcuccauuaagaagaauucuuuuucucuuuucucugaaaagcaucccaggucauaaaauguaaugugggauuguagguuuugugggaagaugcacuuggcagcaauuccuugagaggaggccuugaaaugucagggucccccauucaucuucccaagcugggauugacccagugauaacauaaugauaaugcagcugcuuucaaugucaagccaucaggcagcggguuggggggguugcuuggcccaggaacccgugcccugauguggaguugguaaucuagaggguuuugaguuaagugcuuuugacauggaaaaucaggagccaagggcgaagcugccuuuuaaaugcucuuucugaaagaguccacugcagauguaauugagccucucaggugaagagcuuuauucgagcaaagcugguuaguguugcauaccuguuugggggaauauuuuaggcauccucacaaaacugcuaugugacauugcugaagguccccagccuccuugcucccaaacacuucaagaaggaaaaugcuguugcagaaauguugucuaagcuuuaccauucaguguggcccagaucaaccugucccuucuuuuugugaucacaguguguaauuauaaaguuauuuguguguuugguuuaugucuuccacacuggacuguaagauccaugagaucuaggaccacgucugucuugaucauuucuccuucucuaagacuaacacaaggccuggcauaaucauugucaucaccaucaccauagcuaguauuuauugccauauacaguuauguaaaacauuguaagaagugcuuuacaucaguuauucccaaccauggagucaugagucaaagauggucaaauuggccaagaugaagguguuugcauuuuggagaccaagcacuugaauccauaaccccaagaugugacuuuccaggcuugggauuucgcaacacgucgcuuaaucucuuagcuuacauuuugucaugaguaaaacugaaacaguaauucccaugugcugaguuugcugugaggauuaaagacaaggacuguucuaagcccggcauauaacgggagcccauuauaagugaacugagguguuauuuuaauauauaccuuuuaaaguuugaguguuaggcaugcuguugagugaaagaagacagacuguuaccagaggacauauucuguucuaugauaccacuuguguaaacgugaaaagcaggcaggaauuuuccaugugagagaagucagaauagcaguuagcuuaccaggggguggugaucuuaaaggggcaggaaggagccuugugguaugcuggaaauuuuccauucaucuggugaugugaucacuuggccgugugcacguguaaaaguucaagcuauaugcuuaauauuugugcacgucggugcguguaagcaauaucucaaaacauuugagagaauuucccauucauugacagaauuuuucucccgccucggucaaagcacacaguggguuuucccaacaacugaggugccugaggguugggugccaaagaggcagaaaggccgagaugaccgcuugaccuaauucccuauucagcugaggccuccaccccuggccuguucaaaggcaguuacggaucuuuuacucaaaaccugaaccuaaaaagaaauucuuuagccauguccgugugaacuaaauucagcgucagauguacaaggcugugguucugaccacccccgggcuauuucugaccacaggacagcuuaaaugguguggcccauaaaauguaaucugcaaacucaggcugaauguugaucuauuuagggccaagagaagaccaggccuuggcagcaguucucccugagguaggaucuuaggucgaauggagaccaucacccuggcugccagccccaggaggcuggaaauucguuagcauucuuuaucuuuggggaucggccacuuacuugugggguugacucuuacagccuuugaccaccucccaaaagcuggauucacugaugggcccccaacucaacuuucacuggccaaaguacuugggguuaauuuagcaaaccccaggauccccagagggucccucgguauugugguuuucuccucgcuuccaccuuauaguggcuccaccaggaccucuugacucagccagcacuccuucucaagucacuucgcagcacaauccguuuguuguugcuguuguuuuuucuuuuguuuuguuuuggguuuuuuuuuuuguuuuuuuuuguuuuuuuuguuuuuuugccuaauuugugcuuggcuucuccacagaggccugguucuggucccuuccccugcaaccccaaggcagggggcagauucccguaucauggugcuccuuggccugauucuguggccuuuauauuagaacucaccuucuggaaucuuuuauugucuuguucucucuuccaagcugcgcaucuuccuucccuucagagguuuggugaucagcgugguggcucguuucuauaaucccagcaguuuuggaggccgagacucggggaucccuugagcccaggagguuagagaccagccugggcaauauagcaagaugucaucucuaccaaaaaacaacaacaacaaacaaacagacaaacaaaauuaggccaggugugauggcuuauaccuguaaucccaacacuuugggaggcugaggugggaggauuguuugagccccggaguucaagacuagccugggcaacauagcgagacccuguuucuuaagaaaaaagaaacauuuaauuaaaaauucagaauuggaaguugcauugagccaagaucaugccacugcauuucagccugggugacagagcaagauucugccuuuaaaaagaaagagguuuggugccaggacgccaugaaauaauuacucuagguaaccugaggcuagacaaaccucuccaugucucaguuuccuuccuggcaaaauggggagguaaggccagauuucuucuccuuuaguuuuguuuuucuacuugaauucuauuugucauccucuguaccuaccaccugccaguugcuguauuagaugcuguuuuacucauugucuaauugaauucuccaacaaccuugcaauacgcuuguuaucuccauuuuagaaacgagaaaauggugacucagauuaagaaacuugcucaauguaaccaagucacaauuuuaauauuaaaaauaaugagcauuuauuaagugccuguugaauguguaggauuuugcuaaaucuuucacauaaucucauuucaucuuuaucauagcccuuauggugaaaaugccauuauucuuugacauagaggaauuuugauucaggaagguuaaguaaugugcccaguaucaucuauguauaauugaugggucuauaauuucagacucagguuuguuuaaguccaaaaaucaugccauuaugacuguguaccauguugcaugccuucauauccccaauggaaaaaucccuucucccacuuuucuuaacccuacaagauaugccaagauucuauagcaucugaauuugaaaaccucuacuaauucaugaggcaaucuauuugauaauggcaugauuuaguuaguguuccuuuuuuagagauaaagccucacccuguugcccaggcuggagugcaguggcgugaucacagcccacuguagccuugaccucccaggcucaaccuauccucuuaccucagccucuugaguggcuggaaccacaagcagaugccaccaugccuggcuaacuuuuuuuuuuuuuuuuuuuuuuuguagaaacagagucucucuauguugcccaggcuugucuuguacugggcucaagcaauccucccaucuuggccucccacaguauugggauuacaggugugagccacugcgugaggcccaguuaguauucuuuacauuuuuaaaauaaaauuucagagaaagcaaccaaagggagcauaacucugauaagaauaauaaaaagaaacaauucagcaacucucuuacagauuuuuaucaucaucccauucauaauugauuccaaacgugcaugaaucuuucaagauaagugucuuauugauuauccugaaaacaagcgaucacuugguguccugagauucgcucacugcccuccccugauuaccguaaacagagauguugaugagaagaaaugucacuuucuuugguguuggauccauaggacauuuugaggaauuggguguggggaguggagggagugaagugacccagauagggaggugcuugauggcuugacuguggccuucaccuugcuuuuuguggagcuggauauagacauuuguuggccagcuaauacugucuugaucuguuauaugauccuuaggccaggacuuuuuccugguaauugugcaaaaugucccagugaaugccaauuccuugcugucaggaaacauuaaguuuccuaagugacauccuuuuucugcauguuuacuuaugguuauguaaaucaagcgggccuccccauuggaaaugauggcagugguuacaagggacuucaccuggucuuuuguaguuguggcaaauagauaagauacaaaugugaccugcaauucaguucagcauuaugaagcuguaucugcucccugggugguggucacagcccugcuuuguggcccuaacccuugccuuccugcuggcgggccuugcacaggugcagagaggggguuaguauuggcaagcuaauuggauaaauggugaaguuuccccuggguggcuccauugcuccaggugaagcucuugaaauacucuguagaugacaauagccucaaacuugaacagguucuugcaguuggcaaacagaaggagaccagacucauagguuuugggugcggauaauggauaaucuggcuauugcauuuaauucccagccugauuuauugaggcugccuuuggugaaauauugauuuauaucuuggggggccaggauggggcuacucuguacucagaugaggcuugcucucaggaaguucuuguucagcagcaaaaaucugcccuguuugggcucugaaaguuauuuuuguaguggccucacaaguuucuuguagcaggucaugaagaggaaugaaauacuauaaucacagagcuugcagaagcugccuggaggaccaguuagucuauuuuuuguacaugaggauacugaggcucagagaaagugaggucauugagucacuugaguucuuguugaguguucuuuccugcugagguguccuaggugccucuuaaugccuuuaacaucugcuaagaguaugucacuuauugacguagcaucacuuuauugagcagcuacuauguaccaaacacuuagcauaugcuuuuuggcauuaggagcugaacccagaguggucucuguggagaggugcagguuuacccaggguggugguaguggugauggggugguagugauaguguugauagaagaagaggaggaggaggaacuucucaggaagaaguggcaguucccuccuuuguuucuuaucucuacuguuuagcagccacucuccaaagccucuugcugggaauguggccaucauagaaguaaaugagacaucucuuucaucugcaccaaccuccuuauuaagaccuuaucaguuaccuguagauucucccacuguuguacuuguuucucccucaaccaauuguauuuuagcucucaaguuuuggcaggguugagucuaguauuucuguugggauccggggagcauauggaguguuguuuguuauuuuuuagaguuucuuauugcgguaagugcucaggagggaacagagggagaaggauagaggaaaagcaaagcaaaacaaaauagaaaagcacaaaugaagaauauuuaguccauucuguauuaguccuccuugauggggggacacaugccagccagguuaccugauucaucuaguugugauuuuauugacagucauuucuaccuuguugguauccgcagagguugucuugaagggggcugaugccuucuuucacuagcuuuauguggcuggcaguucuguccugccacucuuuuccucaucaucucagccucccugcccauggcacucaagaguccaccuuggcagaaccugcaacucuucagcgccucccuaaugaacuccuugcaagggcccuugguuaaguuacaguagagaagugguugcuuaagcaaguaguuuccgguaaaggcauaaagauagcccauaauugggugauaaaauaccuggauugcaucuaaaaauaaagacuugugaagguaaaacuguagcuuacagugugcgacuguuuaccuucuuuugguuucuucucauuuaauagguuggucaucucucugcuggcuuuuucccccuuuuuucucccuucuguagaauaacauguggaccauuaacuaugaugcuacuucuuagcugcaaggggggaaaaauggaaaacuccaggggaagagggucuuuacuuagggaguuggcauuuguuggaauuucccaagaacauuucaugauuagugacagguuaucuucuaguuuaccugaaggcuauggucacucaacaaauuuuguguugcuucuuacgugucacgcacugugauaaguccuaggauuauagaagucaauaagcuaugaugccuauccuuaaggagagaaacacauauaggauaggaaaauagcuugccaugucugauagauauuaggcauucagucucucucucucucucuguuuauuauagauagaaauaaaaaaauuauaaauagaaauuuauuucucgugguucuagaggcuggaaaauucaagaucaagaugcagacaggcuuggugucuggugagggcugcuuucuauccuucaaaaaggcaccacguugcuguguccuuauuugguggaagcaaguguguugaauauucuaagaggaaucugaaaguguuauaguauuaaggaagacagauccaagaugguggcaauggucaagaagggugcgggaagaacccuucaacucuaauauuauuugagcugcucacugauaaauaaauaggauuuucccaguuggggaagagggaaagguuuuuagggagcagauuagacaagaaacauugaaaacacaaaguguauuucuugauacuuguuaacacuagguguugaggagacauaaccaaguucuccugcaguuuguguguuaaggcagauggaaaugucuuguaacucaguaaaacaguuuagaaauuuaaagccuuuggagagaguaaguauugagaaggcacaucucuacguuguugacgugaaggaguugcaaggucggguagaugggaucagugccaggucuaaugggcuucauuugcaagaccuaauuucuagcagaucaugguguaagccucaaaugggaggugugccugggaugguugcagaggaguuguuaagagcucagacuccagcguuuagacaacaccagcugcuacaaaggacacugugcauuucuaaaucugaguuucugcacacguauggaggaguaauauggcaccuccucauuugguugagaugcucugggguacacguacaaggcgcucaacucacgguggcuccaccaguaugaaaauguguuaucugcccuagucugaaguacagaagucagguggugagaggugacaugccaugaugugguucugcuucucugagauugucugucagcuuuucccucaguuucaccccccuuucucccuuuuucaagaugguuuuagcacuuccagacauuauaaccagauagccuauugcuagagaacaaagcaccuucucuuccuauauguaccucuugggaacaagggaaccuuuccccaaagccccucaacacacuuaggcugacaucuccuugaccagaacuguaucaaauuuacauagccucaaaugaagcaucugggaccaccaggauuggguguuuaggccauggaagaguaacagcccaguacacaacugucuccaguggccagcacguagaccuucccucacacuuuccacucucugcauccccucuucccucucauguaucucuauuacauggagccucacuuuauaguccucauuaagagacuguggggugguagacagauaacaauguuaacaucaggcaaauggguuuuggauuuagguuaccaucauuuaucuucucuguaaccuuagacgaguugcuugaguucucugagucucagcugaccaagcucuaaaaugagcauaaccauaucaguuuguguuuccuguuacagggagaaaagacugagauaacuaaaguaccugauugaguaacugcucucugaagguggaggcuggacugcuucacuggacaggguggccugggguuauucuagugcagugguagcuggugacaaaacucaaagaagauguaacuagagaaaagguacucagugcagccucugugagcuaccaccacugccucuaguuuuccagaaaaccaccacugaccacucucuguacagaugcgcucaagcgaccauaaccaccaguguuccuaacaaugcgccuauugacuucuuauuucaauagauauccagauugauuaucccucaagguaagcaucgauuuuaccuuugucucagucaauauuuaccucugaggucaauacguguggauauucaccucagcugcagucaauauccauuucguauuacaauauaugaugugcauaugugaaaauaaagaacagcaugguacaaaaaaggucugcuaggcaaagaagcuuuuugcaaagcggauguguuuuuguuuuauuuuuuguuuguuuguuuuuacugugucacuuuuuagaggucagauucuauuucacuaaauaggacauaugugucuucugccaagauguggaauuuuggcaaggcuagcaugauaacaaauaaacauucaagcagucacuuaaugauauugaauugaacaccauuucucagaaguuccuguauuaaauuacaaccauaagaacauacacaagcaugcagauuguaagugugaugagaauggaaacauuccauaggacgcagaguuauuccucaagccccuggacucgcagagaaucagguguaugaagcaagaggaagaagacaagaaucaggaggcaaagagaaggaggaagaagccucagugggguugcuucuuuuuauuucuuagagccagagcuggaagacaaggccuggcauauuuuggcaggccuggaucagagccuagguguguaaauuaggaauugcauuucgcugcugcuaacaaggacccaaacauggugguaaauucuuccacauaaaacaacagaaaauaaguuguuuucuggcccugggcugggguggccacuccaccgucaucgaugauccgggcuccuuuucucuuucugcuuugugacauugcuucuaucuucaugauaacucgcugcccagaaugaccaggcagcaugaaaacgaaaagguggagagggaacuaacuucuucccuuuugaagagcuuucuaagaagccccacccaacacuacugcuucucucccagugguggugauuuaguugcuugagcacagauagcugccagggaggcuggaaaguacagccuucaguccuagcaccaaugugucuaggcaaauacaaaagcucuuuagccaaggaagaaaugacaacgaauauuugggacccacugggaguuugugccaaaccaggugucauugcccuccccacccuaccuugcuccccuggaguguauccugauucuuuugaggaucacuugauccugauuuuuuuuuuauguguauagaugggauuucauuauauugcccagacuggucuuaaacuccuggccucaagcaauccagccaccucggccucccaaagugcugggauuauaggcuugaaccaccaucccuggccuugauacugauauuuuauuguccuaacugacaguuuugucugcccagcauuuucccccaucacccuuguacuaucccauuuuccuuugccaugcaccugucuuccucuucaggauugaucacaaaaucaaaaccauuccuaccagccagaggugggcacaugacccaggucagaccagucacaguuccugauucccggccacagugcaugaugggggaaugagcauauaucaaaccaggacaguccaaguccuuccggggacuuugcugccacaguugacagggggagguauuugcauaacuucaccacacacagcuaagcuggugauccugcugcuuggcagcaucuucccagcguacaacagaggaaaacugccuguuguaguuaaaaaaaaaaagagagagagagagagagagacugauacacaaagagaaucagaaaggaguagagaugaaacaaagauagagcuagcaugauugcaagcugaggacauacgaggagucccugggucagcugggccauacauuuguaagcuguagacaaacaaaaaugaucuuuggguuccuucuuuagcaauuggaguuggaggaggaugaccuuaguuugcgucuuugucccacuaucauuauauccaacuuguguaauuagaaacacuauuuaagucucaguuucgucuccugucaauugggaaaauaucgugaggcggagaugugagaugugaucacguuuauaaagucugcggcaagaggaugauaaagucacuucucaacuccuucucaacuccuccuccuggcuuauuaaugcccauccuuuaaccuguccucugcuuuaucucuuggaauccuuagggccuuuuuaaccccauauacgaagcaaaccuauguguauguguuugugugugcaucaauucauaugguccucugcagccuugcaaagucgauuccugacauuuccguagacuguuuuuuuuguuuucagcaauacucuccagcagcaaaacccaauccgcucauauucuugcauuugcugcagcaaaaccugaccucucuuuguguuaccugagucuugacgaagaagacugaggaaaggccccccccccccccccgccaaauugucccguugucucuuggcuggucuugccagcuggcacacagcuuccucugaccacccugcuagguacaaaucccacaugaaaagucucaaucaccuggcucaaacucauaguuuucagguggcauaagccauggcauuuucaccuccuuuccugguuguuuccagaaagggaugauagccccagugcaguggcucuguauuucucagggcagcgugggaccucaggguuugucauggaccacaccuuucuccuuugucccuuuuuauaacucauaggcuaccuccaacuugacacuuauuuaaguuuuuauuuauuuuauuuagcauucagaaaacucuauagccucagucucucgggauguaaauuaaagcaauuucauuuucauaguuucucuguuucaaaucccucauuguuuauuuaaauagcagccuaugcauauugcaaguaaagaauuauaauuaagagaaccagaagggccugucucucaggaaagcagugauuuccuuucacaauaacccuauccuuacuguugaagacuuguggaaaagggacauggcccagggaaccagagugguuugggaaagcacuuugucaagaggcuuggggaccccaggguggaagcugccaugcgcaugaggcuguguuagcagaggcaguggcagaagaagacauugcaaaccugcaaaagcaaccucugaggauggguagacauauacuucauugcaggcagcugcugcugaaauagauuuggagucagaugucauauuccugccagcagguuuagcagucgugggacuagggaaguggcaauggcaggagcaacuggaaaugucuuuuuuuuuuuccuccuuuuuccugaauauggaaccaaagccuguguuuuucuugcucacaugugagucuucuccuugcuucaacccuccccgcugacagccacaagacuccugccucccugcagccuguggaacguaauauucguugggaucauacauugaccaaagauccgccaugucuuugcaacuaacauacucacucaugacuucacguggcuauguacaagaccacaucucucaauggugagguccucaaucucucccuccccaccacaguuagcuaucagagauauacgguguccuuaagauagggcaggcagggccaccugccccccagcugaccaguguggaugucuugaugaugagccauacucagaguggcccuaggauggcuccucagauagcugcuggcagaaaccugcacucaguacaucuauacaugguguaaugauugacucaagauaauuagcauagccaucaucucaaaccuuuauuauuugugaugagaagauucaaaacccgcuuuuugaacuguucugaaauaugcaauaccuuguuguuaacuguauucaccuuucugugcaacagggcaccagaauuuauuuuugcuaucuaaaauaucaauuaaaaauacaauaaaacuaaaaagaaaccugaacucaggagaguggaaaagaacuucaacauucaaaggggauaagacauauacucagagugggaaaaauacuaaaugguaggaagaugagaaguuuuuuacucuuuguuguuucugcucauuuuuuauauucaaaauuucuaaucaugugugacuauauauguauuauacaugguaggacuuauuuuuuuaaugugaaagaauauaaaacaaaauacgauauuaucuuuugagugauaucaacaaaacaaaacaugauauccaaagucacccuguaugguuggauacuuuggguuugccaucuuuucuuuuguucauuuguuucaugcaauagaaacguuuugagauccugucuggcuggguucugcuaggccugggucuacagcaguuugcugucaaggucuuggcccuucaagagcauguagugugguggggaagguguacaucagugaagagguaauccaggucacggugggaugacacaggcugcuguggcaacccacagcaggaauagccaguccugccccagcagggcguaucaggggugcuaaggugacuuccaagauugagguuggcgagaucgugacaggugugcaagaugggguguuccaagacuggggacaggacaggugugcaaggaccagccagcugagguagaggaaaccuagaccuauggaacaugcugauuucaagguccauuuguggggagaacacggacugugucauuggaagccagcagggagaaucaguugagagguaagccgggccuaguagaaaguaagcgaagcccuuucauuaagugaacgaagggugcauggugaguacacagccaugaaaauaaaaugauauaaaucagcacgguuucagcugcccucaucuuucuacugugaucucagcagugauggggcuggcuuugaggguuggagaucacacacacacaaucagccagcucuccaaagcaagccccacacucucuugaugcuauccucaauaaacaugcggucuaaacaguaaccauguucuagcuaugcagaugcaguuuaaagacaaauccuuugagccuccagcaugcgauccccucccaaucucauugcugcuccccuacccucuucugcguagaagcgcuggagccaggugcuuacgaccugggugcuaguaucuuugugaaaacugcuccugaccuauugcuuuguuuauuuuagccggugccuuuguagagggaaaacagcuuagcaagcauuuaguagguagauccaaaguccccaggagcuguugggaaguccauaggugcuguuuccauugcuuuuucauuccuucauauauuaaucaaggagucagucaaucaauuaaacggauacuauuagcaccuacugugugccgggcacuguacuuggggccauaugcacugcugauucauucauuuggauucuacgguggcucuuuacccauugccaucauuuuguaggcagugagugcccgcaucagugggcguuuuauguugcaccauuuucugagcaaugucuuugguccaccauuaagcauuuguggccgcccaccccacaauaugcuuugcuuucugcuuucagaaacaauacuggugaccuguuuuaagaaaagcugaaaagccaggacuuagauuuuucuggaaaccuucaaauuaaccucauuaaguuuaaaauuguuuuuuucucguucaucucucuugcuuuuaugcuuuccaaaccccuaaauuguggugccucagugaucuucuauaacauaaguugauagucaauaauugcuuaaugggaaucauaaauaugaguuuauuuauauguguauauauauauauauauauaaaauauauuuccaugaauauacugaaugcuaagcccuccccacuuuuuuuuucuuuuuuaaauucagaaauuucuaguuguguuuauuccccucgucagcauacuuuaucauaucagagccuuuucagacacuguaaaacuacugaguuauguuugggucauguuuugcgguaugcccuuuaauaguguagcuuuagaaaugcaauuuucagccucugcuuauuagaauaugauaaaguauuccuggucuauguccagcuccacuaaucuccagacugcgcuucaugaauuaagcaugaagauuuuagucaaugugcuuucaaagaccaauguuuagggaaucauggauuuucuacaagcugagggagaaaucuauaauaggaggaacugauuuucaaacaucauauucucaagaagaaaugaccacuucuggcccagaaacagaaaauauuucacuaucagaauuuucuagaaccaguuaaaaccacauugugcuguuagguuuaauaaacggauuguguuuuaagauguguaagacugucugucacgugggaggauuucaaaugacugcuuauuuuggaaagcucauguagacuggguuaaaaucgagaggggaaugcaaauugaauuuauaagguauuauuaacuucuuccucuuuccccccgcccuggccccugugcauuuugguucauuuugcucugauacaauucagcaaauagccagauauuucuugccauggcgagagcuuaguugggggagagauuuugaccaggcaggcucucaggucggugccaucggugacgccaacacaccuccuggcuugguguguuuuguggcauuuggcaggcaaacguuuugaaaagaaaucuccuuucaaaaaucacagcacugguugaagcaggagcaucucuccccuuaaaugcaaaaggaguuaauaugccagugacuacagugugccuggaaaggucacuggaggcauuuuugucuggggcagccccuggagucuuggcuuuugugcuuggugagaccuuaucuggccucuucauuguccccuucauacaaauagauagcuuuuagugagcagcuacucugccuggcacuguucuaaacacaugacaccaauagcucacucagauucccgccucucaacagggaaacugaagcacaggaaguuucagugaugcacuuaggcaaccaguaaguggcagggucggcauugaggucaagacugguuggaccccuaaguuugaacaaucaaacuggacuuuggggcucacaguuuguuucaugucaggaagguguccgaucagaaccugaaugccagcucaagcugcucucagcuaaacuccagggguugcugauggagacuucauccccuccuccagucccgggaucaagacagaaauguaaaucaccuccaagaaugggucugcgucuugcacauuuuccuuuugagaaagaggaaaauucucagcuggucuagcuuugucugugaaccuccgggaucucucaggggcuuuaaauuaauuaaucaauccacagacauugaacugaaucuccaccuugggcuugagacucugcaaagugcauuaaaugggaaggaaaccaaagggccugcugcccugcccccgccauagccuaaggcuguggccauggcuggggaauuggccugucaguucaaucaggcagccccucugacugguguuuuucacuaagcuggccccauggauggcccuggucauguguagacauggccucaggagggccacauuccucucauuuccaggccuccccacuuaauuguuccugacacaguuuggggagaaaugcagcaaaacccaggccugccaaucaacauuugcucccgagucucagagcggccccugaagagacagguuggaccaagggacauccacagaugccuuguguuuaggaaguggggugugggcaacagagggagaauuguuacccccgggagacugggggugcugaagaagagucucagucucugcacucugggucuugccaaaaccucugggauugggugugguguccauguugaggaagggacagugagcucucuaaaugacagugggucaaccaccgcauuucuaggacucaaagaugccguggggguguauuagucuguuuccuugcuguugauaaacacauaccugaggcugcauaauuuaugcaggaaagaggcuuaguggacucacagcuccacauggcuggggaggccucacaaccaugguggaaggcaaggaggagcaaagucauaucuuacaugguuggcagcaggcaaagagugagcuugugcagggaaacucccccuuauaaaaccaucagaucucgugagacuuguucacuaucacgaguaaagcacaggaaagacuugcccucaugauucaguuacguuccaccggggcccucccacaacacaugggaauugugggagcgacaguucaagaugagauuuggauagggacacagccaaaccauaucacagggucaccuguagguuaccguaaauaagagaaacagaccaaguagagacucagcauagcuggagggggggccccagaugacggaaacagccccccagcuccagccauuuguuacuggguuguuuccaacagaaucaaggacucggauuuuuaugugaagucaucuccauuuuaaguauucuuuucuuuccccccaacccuccguggguuaaagcauccauguuuacagaaugaaagaugagggcaggauaccacuucuccuagggaucaucaucauuuuguggggcuauaguccagagaggugaaggacccaucuugugacugcacagcuacccuguggcaugacugagacuauaaucuucuggauucuucaggaaacccugguagcugaugaaacugcccuagaacgacagcaagacaauagggccaugaaagcauaagcccugaagucuggacacugagagaauucuaggcuugacuucucuguacagccaucuugggagugcucaacccuuugaaucggaugucuagaauggacucagaugucacugugcaggugacucacgccuagaauccucugccuaucgugacagggagaagccugugugacccuguggccaucucagucucugcagggcaucuguagcuuuggagguaccugggcaagagacugccuuuccuacuagagcuucugccaucccucugucacuauuuaaagcauugccugcacccucaaccucguucaguuuccacauaauaccuggggcagggauguaaauacccugauuuuaugugucaggccuucaggacucaggguguauaagugacauggcuccucgcacagcagggauggagaggcaaacccagguuggccucucugccacucauauagaacuccuuuaucaccaagauuccuuucuucuucagugccaccugccuuauuuuacucacccagaaggaagccgggucccucuuugccccuuuggguguuugugaaaagcaaguugcaaacucugaauucuauaaacuguuggagacagauucuggagagacacucaggcuuagcucuagaaagaaacggguaagacagaggagguucagggcaacuguguugccuuccuugacuggugcaugggaauuccccagcagagagaaaaaaaaaaaagaaaggaaaaaaaccagaaaggagaauagaaucuauuaucuccaagccauuauucacacacacauaccccaccgccauuuuccaaauuguaaggucuuuuuauauaagcacuuuccguuaaaggggaagaaauagcuuuacccgugguguaaaauauauacuuucuaauguaaaucaagaagcuaugaauaccauaauaagaaugugguaguauauuaauugauggaaauuguagaguggaauauucauaaucagcagaagucuuuucucuggaaggaacaaaggauuaaguuagggagacaguaaugguauuguuagcaggcuauuucaaugauuuucucugcggaagaguagggaaaggugacauuccaacugggaauauucgacucugcagaucccuacucggaguuuuucagcccuguuuuaagugccgagcuggguuuugccucaugauccaauuguuuuauuagcgaaaucaucaucuguuucauuuugcuuugguaauagugcagugucugucuaacaauaaauuauagagucaggcaaacaaugguuucguauuagggauauaaugaaauaucuuauuaaaaugcagacuuccuuagguuccugaaauuagagucuuauuuuaaaaugauucuguugggcuuauuacacgcuuuugaacuaaucacacuaguagaaucucucuuuagucagagcauagaggacugugagaguuaccucuuacuucaguauuuucccauucguauuuuauucuccuguucucuucuggauagaucuggauagauuuuuuuuagacagagucucgaucugacagccagacuggagugcagugguguaaucucggcuuacugcaaccuucaccuccuagguuccagcgauucuccugccucagccuccugaguagcugggacuaaaggcacgugccaccacuccuggcuaauuuuuuauauuuuuaguggagacgggguuucacuauauuggccaggcugaucucgaacuccugcccuugugauccacccaccucggccucucaaagugcugggauuacaggugcuagccaccacacccggccucuucucgauagaucuuauuuggcugacaacgaaagcuguugugcugguagcaucaucccuuuccaugcaaaagauaaacugaaaucuaaaguagccauauccuuccggccagguuuuucaagugguuacucuguucugaucauugucaugacaggaauagugaaaauaacaauaaaucauuuuucuuuaacgauccauuuacuguaugcugggcacugcacaaaaugguuuacaugguuuaucuuguagcguuccauuuaagucugcuaagaguagaugcuaucauucucuccauuuuacagauaagaaaauugaggcuuagagaaauugaguaauuuuugccaauccugagacuugaaucuccgcucugucuucugcauacacuuuuuacuugucauugcugauuagcuuucucuuuccaucucccugaucagaaccauucugcguucuuagauucaacaaaauguaauacuccaccuugccaguaucuagcguguuuucagaaauugugaacgggguggagguggaguacuaacugcaaucagauguuuuauuuguuuauuuauuuuuccuucuugcguugcucuuaagcccccacucuugggcaaggcucugugcuaugcuguuuuaugcacaucaucuucuaacagcuucucugccacaccuggagaagugccaauaucauuuucauggcacagauaaggcauuggaugcucauaguuuaagucaucagguggugacuggaggagccagaaggucccuuugggccuguccucucaccagcaucaacugcaccaaaaagaucucauucugaguaucagggaugaacgcccccacugggugaucaggcaaacuacaugcauuuuaaaaaacuauauccugcugggugcagugccucaugccugcaaucccagcauuuugggagguugaggaggacggauuacuugaggccaggaguucgagaccagccuggccaacauggugaaaccccaucucaccuaaaaauaaaaaauuagcugggcgugguggcagccaccuguagucccagcuacucaggagacugaggcaggagaaucgcuugaacccaggaggaggagguugcagugaacuaagauugugccacugcacuccaaccugggcaacagagugagacacucucaaaauaaguaaauaaauauaaaauaaaauaaaaaauauguccuguaaugaaauugaaagagaacacuuuguuucuuaucuaguuggaacaagugggguggggacagacaagugacugaccacucuccaucugacucagugucaguagacucucucaaaaauuagaagcuggcugacauaguggcucacaccuguaaucccagcacuucaggaggcugacgugggaggauugcuugagccuaggaguucaagaucagccuggguaacauagggaaacccuucuacuacaagacauagaagaaaauuaguuggccaugguggcacacaccuauagucccagcuacuaaggaggcugaggcgguaggaucgcuugagcccgggagguggaggcugcagugagcugugaucacgccacugaauucuagccugggugaccgagaccuugucuaaaaaauaaauaaauaaauaaaauuagaaucugaauuuugaagacacaaauucagaugcauguggaugggcccaaaauacuuuguuuacauguacuccaaauguaacuccuggggcacccuuccuuauuuucucuaccacaccaaugccuucauggucuuacaucuuguccucuuaacccugacuucucuagcccucaugaaugcuuuaguguggcagauguuacuguacaugggcccucguuuauucagcaaauauucauggagcccuuguaccaagcacggugcugagugaugcugugagggugagcaaaagagaauugucaucuguuaaaucccagagguccgucugugacaaaacuuucaccauucuuuuguaaaaauuagaaaaauacaaaauagugaguuuuucaugagcuacguuguaucaauuuuaaaguauuucuuuuaggauucuauuauuuacccuuuuucuucaauguuaaauaccauuuccuuuaauaaagauuuaaaaaagauuccuuccuuccuuccccccucccuccuuccccccucccuccuuccccccucccuccuuccccccucccuccuuccccccucccuccuuccccccucccuccuuccccccucccuccuuccccccucccuccuuccccccucccuccuuccucccucccuccuucccuuccucccucccuccuuccccccucccucccuccuucccuuccucccucccuccuucccuuccucccucccuccuucccuuccucccucccucccucccugucuucuucccucccucccucccuucuuuccuuccuuucuuuccuuccuuucuuuccuuccucccucccucacucccuccuucccuuuuucccucccucucucccuuccucccuucuuuucuuuccuuuuuaaaugcugauuuuguuuucuuuuuaaagcccucaguuggcaaacuuaaaaguuguuaagucuguguuagccuggcuagcuuuuuuuuucucuacuagaccuucaaagucuaggaaugccugauguaucuguauccugugaguuugccacuucaugauauuugauaugucauuguuuccccauaauuuuuucauuguuagcguugucucuccagccuccugcuuccucuuccucugucucccucauggugugucuugcucaggcaugucuuauauaaucaauauuuagugauuugacuucuuaaguccuuaaaaaaaaaaaaauccaggugcaaaacacaaagacagggcucaugucaagggagggaaccucgcucuucuacucucagugaaagaaaggcaagaccacuccagccuauuuuuuuuuucuuucccuuggcccuugucaaaaggguagccaguuuucuguuaccauugugcuaacugaagaauggaaaauaugcccagaguuuaaaaaaaaucaaccaaugccugcccuuucuagagcaaccuaauuaacaacccaaauguuaaaauuucuuuauuuagaaacucagcuauccagaauuacaacuccgccucucgugcuuggaggcauaguucuuugucauauuccugagugucuacagaugaugaaaauagccaguuaucuuugcccuucauggaaaggauaggaagaagcucugaugaagcaauguuggggcacucaugguuaaauugaaccuuuccccugguuaaguggaguguguguguguguuguucuuuuuuuccagcaccauauuuggcccuauaauuaauaugcaaguucaaauaccucuugcauggagcaagaagcugaaacaugcgcauuuguaauagacucagcaucugaauugaaugggcagcuuuggcuggaguaguacugcagcuucucgaaugccuauugucaaaauauauacuaguuaggagacacauucugcuacgagggaugcccucccaaauuaaagacacuguucaguuuacgcuuaacauuuauggcuaucaaacuacuaguccacaaccaaucaucaugguuucguuaacacagucaaaauuuaccacugggcuauuauuaaaacuuaauauaauuaauguaaaaacacauacuucuuuucaacaaaaacuggcucucuuuguagucucuuuuuuaauuuggugcaaucacuuaaaaaguuuagcacauuuaaaauuuuacaucauuuuaaaauuguuucucuuuuauaagaaggaugcuauuuacuauuaauguagaaguacaaaggaaacgguuacuuuggauuuauucuuuuggaaaauuagaaugugggcuacaugcuuuucagaaguugaugaccaagagaagaaagaaagaaaaaaaaaagggugcuugaugcccugcuccugcuauguccgggaauuucuuguacccuucauaugagccccucugaacaaaagcaaauccuguugaccugucagcuuaaaaagacaagaaauaugccacauuccgcaggaauaaggagaaaagaauggugcgaaaaucagugacacgaaguugaauaugugaacacauccagacaaaugugaagccagcccgauuaggacgacugaaagggcauuuccccagaauugcaguuuuuuuuuuuuuuuuuuuuuuuuaaauaggggacgcuauugucauucagaaagccacaggcuguucugaaaacaggcaaaaaucaauagcccacuuguugaggauaagugaauuagccuguguugaauguaacugaguaccugaacacuugagugggcagggauuguuggggagaaaagacaauugucuuuuauguccacagcgguucacaucgcugauuaauuauguccaaugaucauuuuugugcaggacuaaugggcagacucuguuuuuguuuuugucugucugcccacaaccuggugaacugaauagaguuccccacuucucagaacaaugcaaaugguggccaaggggcuguggaagaguugccagaaauggaaugauucagauuggaugaaaaguugauuuuauuaauuaguuaaaauacaaaaugagaaaacagaaaacacaauaaauacacaguuaauaaaauacuucauauuuuauuauaaaaacauuaauuacuuuaauaaagcgguuuauauuuucaaauacaauauuuaauaaacuauauuaaaaauauauacaaaauaguuguaagaaucggggcuccugugaguacguaaaugaaauacgcuuacaucauuuacuucucuucccuuuuguuugugaguccagagacgauggaagaguuuggaaaguugucagcuuaucuuugcauauauuuguccaaugauaauuaagcacaaauuguuucaaaaaucuuucaaaaauuguuauaaagauuuuuauuggugcuaagggcuguaauuuagcaaagucuuacaccugaaaccaaccaaagggucuuagagugugaacuguugucuuagacccggagaagucuccaaagaaugaccauccgaggcauucagcuggcguaagaggagugacucauuuguucuucuuuuuuuuuuuuuuggcugucuacagagaaggaggauauaggggcccuuaagagaaaaacuggaguaggguguguguguguuuguuuuggucaagggcagagugugcugugucaggguguuucauugcauuuucauauuugucauuucucuuuggagcgugucuuuuggugccacggaaaagggcuggauuuucuaucggguacaauagguaccugcagggcuuaggguacaagagcuugucggggaccugcacacauguuugagaccuguaaaaauauugcuggcucugaauuauggaaagaaaaucgcaaaguuaaaaucuaucaaaguauaauuaaauaccuacaaaacauaauauuaugucacuagucaaccgcaacacaaaucuuauaucauuagauuucagugauauugaaugugggagauggaaccauuuuagugcauuugauaugaugugauguggcuuucuccaagccugagagugccugaaacccagagaggucguacguugaccaugccacggggcccuuccugguaaaucuaagcagaaauacaccaugcaugagacagaacaaagaaaagaacugugaaaauacacucaggaccaggaugcugauacagucaugagguucagcuuaaaaggccaguuucucuacugcagaauaaugaggucuauccuguuuugcuuucuuucaaagcccuuaccauuuaugaaaccagauugcaagucuguuugaaucccccaaaugccugugcuacauaacugucuccuuacucugugcucuugccccaggcagaguggaaguugccuuauaaagcugcgacuuggccacaguguuuucccuuucagcagggaaaccggaguucucccugcuguugggagguucaagagccacucugugcagaaaugcccagaaagaguuaagugagguaaguucgucagacuucugcagacccauacuguggaagggucaagugcagggucaccaacccguuccaucuuccugucaguuggcguccacccuugguuucaaagggaacaggcauuacugacaugacgggaccuuuacaguucccagcugcucauuuggaguacugcggacccaggacaacuaaagccggggucgccugcccuccagggguuccuggguugaaguaucuguucccucccuuuauuuuuucuagccuuuauagaaaugacaaagggucagguggucuuaaauuccaaaucugggcacaugaauggucugaccucggaaacuuccuauaugcucgaaacgauuuaacuagcagcaauaaaaucucuacucuuuuuaugacaaauaaucuagcaugucuggggagcauauuugauucuucauauuugggacccuuuuuuaaaggcugaguuuuauuaaaaugauagaaaaauuaguuauuaaacaguaugucaaauaccuuucugucccaccagauuuauuuuuaaagacaaacauuacagaggggcaggggaagguuauauuugaaaucuuucuauccuuucucuaaaauauauuuggugaaaacuaggaaguguugauagauaucauuguuuccugacagguuuuugguguuugcaucuugaaaguaaaacugccaaguuauuuuuuuguucugguuuuuguuuuuuaagcuuuucuuugauaaccucauuuucaaggggaggcuuagcacugauguauuuuauuuucuugcucagagaggaaacacugaaauagcuauaugcuuccccaccaggagaguggaagaaucuugcuuuuaaagcgauaguccuauuuucuaaguaaaaguccaggcaugugacuuaaaaaagaaaaaaaaaaauguuuucuggucaagucacaugccucugagguuuuuuuuuuucuuucuuucuuuucuuuuuuuuucuuuuucccagacuccucauaccccuccuaggagacagugauucccuggcuucaccaggcaggcucuugggggcuuccuggucccugucacucuuaaaaugcagccugucuuuggacaucuacuccaaguuugcauucugccuugccuugucagucugggcuaucaaaaauauaguuucguuuggaaaacaaaggggugagguggguccaaaguacaggaagcuauaccaugcaaaugaaaauauuuuuuccaaagcuaucugcuaaucccugugauuuaaaaaugugcguguuuuuaguuucugucuaauuucaaccuuuucuugcuuuagugauuaauuaccagguuucucuauuaagagcuugugcguguguaggggguagcauagaauaaacaggcucagagcccccacccccaccccccuuuaaguaacagugacgcaaacgaccuuuauuuagcagaagguagcucugcgaauccgcugaauguccgauugcgaucucgcuggaaagacugcugcuucagcaagguuucuuugcuggucuguggcaaggucccugcuucauuuucaagguguccucacuuggugccuuugaaggguuuuuaauggauucgcuugauauaccuuccaaauggaguacuuugugcguuaauucaguuugugauaaagaucccuuuuacccuccuuuucauaauucuucccagagauaugaaguacacuagaagguuagauguggcauuuaauuuuuccacaaaaccuauccauagagggggaaaaaaagauucaauuucauuacuauucauguguaagaauauugaaggugguauacuaaaggagauaacuauuucuucuucuaucaaaggaagaacaaaucugucuuugaacgaggagcucaauucuuauuuaaaagauaaaaggucaccuacaauacucauuccuuuaaagcuauaguguuggggugggaaggaagcugucuuaccuggacauauuaauuuuaaauuuugcuugaaaaaauugcucagugcauuuauugacuagucucucugugugaguucugaaagucuguuuauaucuguugccccuucuccuaaagugaacccagauauguggguauggggugcuaguuuuuauauuaggucugagauguggaaaacagaaaucuaacuuagggauguaucauaaucaaaccgucggggcuaauggcauggcucugauauuauaaaaucuggagguuuggaaugcagcaaacucugggggcauuaucauuauuauuauuaauaguuuguauuuacaaauguggcauuaaguagaacaacguauucuugcaauuaaugacaggaagccuacaauuucucauuaagcacaggacagugagaacgaacggaauuucagagacauguuucuuaacauuaaaaacaacaaaaacaacaacaacaacaaaaaaccaaguaggaagcaggcagaguugcaauaugaagaacaauuucaaucauauguuguuuaauugaguuuaacaaguaaauguauaucccaguguguguggucaccaaagcauaaugacaaguuguucaucauuuaauuagagauuugcuuauugaaacgacugaaauagguaguugaaauuuugcccuuggacaagggaguaauuugugauuugcuacguucauuucgugagacuuuuggugaaagacaucuccuucucauauguuuaggcaagcguugaugacaucaaccuagccuuuuauuuuaaauccccugucaacgcaauuagauaauacaaaaauaacaaaacuacaggagguugaggauggggcugggggccaaggagauuacuugguuugaaaugaauaaauugucuauccuaagggaauucuuuggugcauuuuauugugugaaaugagccuggucauaugacugcccugccucccuggaggccucccugcccuccuccuucccacagacacuuaugggagguacuggccagcucuguauggccaguacugcccuaagcaagaccaagaagcuuagucucaauuucagagaguuauuuuggcaacauauuugggaaaaugauaguuagaugcugcguuagccagccucugcaugauuuuuuacgcagaacaaacaguuccaaauaucagugcuuucagcaacucauauauuucucacuuauggugcaugucgcugaugguuggcugcugcucugaucucacuccaguaucagcuucagucaaggaacguauuguugucaaggaaaggaaaaagaacaguggugagaccaaaggaucuuaaaguuucuacuuuggaaggggcguggcauugcuucucucauuccauuggcugaagcaaaucauguauacaagccagaagccaaugagcuauaggaaggguagcaaagaacagaacagccauacagccuagcccacagauggggucaagaagauucaauaggcauuggcugaagacuuaagacuucucaagcaaguuggauccuggugugcaccuggcauauccuuuaggauucuuuaguguugguagauugagauggaaaugaggaaacuuguauuaccuacuccuuugggccagaauuugcuuacagcacagugaggagguauucuuuggagagcacuguuucccaagagugauucuaacaaagagguguaaauggacaagaaugaaaagcaauugcaagggcccuugaagguuugugaaggauggcaaagugacuuggauguugauuucuaaaggagguaaaacuugaagguagacaagcucuuuguguccauacauuugaugggucauccuaugaaggagggcccaucucuuacggcaggcagcguggcguaggccucagagucaggcaucuggggcccagccuuuucucugcaggugcggguggcucuuggcacaugauguagguuuuuguuuuuguuuuguuuuguagacagagcucaaucuuuugccuaggccauagugcaguguacaaucagauuucauugcagccuggaacucaugggcucaagcauuccucccacaucagccugccaaguaggacuacaguugugcacuaccacaccuggcuauuuuuaauuuuaguuucuguagagacagagacuugcuguguugcccaggcuggucucaaacuccuggccucucaagccauccuccagccucagccucccaaagugcugggauuacaggcaugagccaccccacccagcccauguuaauuuuuucaccuacaaaaugaaggcuacaauauuuacuuugcaggauugcuguaaggauuagaaccaccgucucuaaggcauucagcauagucccuuaggguaacaugagugcucaagaaauaguaaauuuuaguaugugucucauuuuuuuccagaugcucuggggucacuaccaaccuugccuuucacccuaccuguggaucuaugacccuguccuucucagaacaccacucaguacuucuggguuccccaagaggugccucuugagaguuuguaggaaacugugcuuuaguaacucaugguuucugcccucagcuucucuugcauggggccuuccugcuugcuccucugcucacaaugacaagugaggacuccccuccaugccuuuugaugcuggugcccaucaccccgaucacaugaacgucuaugcccaggucccauuuccugacauucccaacaucucuaccuucuccgggccuagggcagggaucacucuuucagaaacaugagcguauggaagccccaguguguuccuugaagucccgaugcgugauuuguccccaugcugugucgcacuuggucaucuggacccugggguugccugagugucccuguuacaaggccccuccugaaaccagauuggugucuaugagggucaucugggaaaccuaccucuggcagaaucgcuguccugccaguuuccucucccccuuacaagggacauuuaugcuuucucccucuacaaaaccugcaugcaaauuaucugauggaauugacccauaguggguguucuccacugguucaacacaccugaauuccggauucaagaugcaaucaccacuacuguuguuguguaaguauugcuagagauggcugcagaauaccugggaaagcuagcuaagcagugacuggaggaaggccccagcucuuuggaacgaacuuuccagccgagaaugcuuuccaaaaugggaacaagaucccaaccccuuaucagaaacuuugggggccggauguguuucagaauucagaaguuuucaaauuuuaagaagagaauacacugcguauucuguguauuacaggggucagcaaauucacagcccauaggccaaaucuggccuguuuuuguaaauaaaguuuuauugcuauacagcuguaccuguugguuuacguacugcgauggcugcuuucagcuacguuggcagagcucaguagucaugacaguaaccauaugcccacaaagccuaaaauauuuacuaucuggcucuuugcagaaaaugcgcugaaccuugcauguugugucaccccuggagguagcaccuuguaauuaagcacaugaauaucucacaucagaaugaaugaauauucacacucagugggacaaacaacuucugucagcuguagacugcuuuugccaucaaaugguuauugaaagaacuaucuguguugacagccuuuuggguuucauacaguccuuuccagcuugggcaguauagauaaauagaugcacaaagcagagggaaucaaguagaauaacaugguuuauuuguguguguauuguucuguuuuugguaaaaucaugcuuaucauaucuucaaugcaucauuuauucugaguccacauugcugccuuugagccggggcccugagguaucuccuauacucuggcuggggugagggcggcagguccucugggccagcccagauccacccuguucacgguguguguccugcugggcucacuucugaagcugaccuuggggagcagauugaacaccuguugaugccauucucuuaauuucaggggaaugugugggucuuugagcuagagagacauagguguauggcagaugagggaccacccccuccaccuuaguccaguuacagggccucgccuuuuugauacuaacgcuacaugaagagggacggggccaacagcaggcucuuccuugacguguuuuauguacacuccagaaauauugacagaguugucuuuuuguuuugguuuuuaaauguuuuuuuaaguuaacuucuggaaugcaugugcagaacgugcaggcuuguuacauagguauacaugugccauggugguuugcugcagccaucaagccaucuuuuaaauccauucuuagauuuuccuuuuccauagcucuuugugaugcuugcuuuaaucaguugauacauguuuaaucacguuuugcucugggcuguguuauauacagcucccucccuaaucuugcuagaagguagggcuaaugcauugucaauucagaaauaggggguguuccugagucuggggacacucuagugaaauucuauguguaaaauaauuuguacaaguuuauauuuuuagcuaaauuaaaauacucacauucccauuauuuuuuagagguuguaagcuaaguaauaacauucuagaaacucucuguuuuuugaaagggcaucaccacuguugaaggcgcuaaugggagauccuaaguuucaggcucugcuacagacgucagguccccuaggaguugggcugccuuugcucuccucuccgcgacucgguaccugguguauaguuggcuaaaaagaaguuguuggggcugggugcagcaccucacaccuguaauuucaacacguagggaggcugaggcaggaggaucuccugaagcccagaauucaagaccaggcugggcagcauagcacgacccaucucuacuauaaauuuaaaaauuaacugggugugguggugcacaucucuagucucagcugcuugggacuacuagaaagguaaggcaagagaauccccugagcccaggaguuggagguugcugcagcuauguucgcaccacuguauuccagucugggcaacagagcaagaccccauuuccaaaaaauaaaugaaauaaauaaauacauaauaaauaaacaguagugguugaaagaaagggaaggaagaaaugcuguuuuaggaaaucaauaggauaauuuuuuuuuuuuuuugaggcggagucucacucuguugcccaggcuggagugcaguggcacagucuccgcucacuguaagcuccgccucccgaguucacgccauucuccugccucagccucccgaguaguugggacuacaggcgcccgccaccacacucagcuaauuuuuuguauuuuuaguagagacaggguuucacuguguuagccaggauggucucgaucuccugaccucgugaucugccugccuuggccucccaaagugcugggauuacaggcgugaacuacugugccuggccaggauaaucuuuaagaagaagauaacauuagcuauucuucucacuuccuacguagaauucccuacccugugucuuuggccuggaaaggguauugguagcaauugucuucggcuuucccugccauguguaugcauucccacggccacacaagcacacacacacuuuugugguuuuuuuuuuaauuauauaagcaaguaggauguuugucuuaguuuuuuugggcugcuauaacaaaaugccauggacugaauaauauauaaacaacggaaauguauuucucacaauuccggaggcugagaaguccaagaggaaggcacuggcagauucaguguccggugaggauuuguuuuugaucucauagguguccaucuugcuauuuucucaacuagcagaggcaacucucugggguaucuuuuaaaagggcacuaauggccaggagugguggcucacaccuguaaucccagcacuuugggaggccgaggcaggugucucgguggaucacuugaggucaggaggucgagaccagccuggcugacauggugaaacccugucucuacuaaaacuaaaaacuuagccaggcucgguggcuugugcuuguaaucccagccacuuggaagggugaggcagaauugcuugaaccugggaggcagugguugcagugagcugagauggugccacugcacuccugucugggagacagagggaggagacuccaucaacacuaauaauaauaaaguaaauaaaagggcacuaacccuacucaggaagccuucacucuaaugacauaauuaccucccaaaguccgcacuuccuaauguuaccacucuggagguuagaauuucaacauauaaauuuuggggggacacauucagaccacaauaauguuuuauaauguuccuuuugcuuuaacaagagacacaugucagauaguagacaugaucugagaagacacaaaacccagcguggugauuuuggcagccuugccaugcaucucuaacaugcacauggccagaaaaauagcuuggacauucuguucaacccuccacaucaacuggucaguuuagucuuuaaaaggugauaggccuguugugguggcucacgccuguaaucccagcacuuugggaggcugaggcagguggaucacuugagccccggaguugaagaccagccugggcaacacggugaaacuaagaauagaaaauauuaggugggcgugguggcgugcaccuguggccucagcuacuuaggaggcugagguggaaggaucacuugagcccaggaggcagagguugcagugagccgacauugcaccacugcaccccagccugggccacacagagaaaccuuguauccaaaaaaaaaaaaaaaaaagugaccacacuguggcuuugcugcuuugccuaaguauuucgugaaauugaucguucauucacaaugcucagugcagugacuuugccgagcacaagugguggacuuaagaagccacauaaagaagcacccacgucuuucucugaggacgugcuuguguguguucugaggaaagcaggugaugaucccugagguguaucccccaaucccaaacuagaagugagucccccugcuccucaagcuugcauggcgcucagguauuccagugggccccgcugcauucuucccagucccaggaaaucuuugugcauggcugucuuuucugugccaucuugggcaucucacgcauuggcccuauccacauguugccuccagcaucccaggaacuccguuaauguuuauuugaaugauggaaugaaggugucuugcuauauuuugacauuucugucaaaauaugaaucuaucuuugccuagcaucuuuucaugugcacauugcccaucuuuauaacaaagugugagugggaaaggacuuuuaaucuucauuauauuaucauucauaugaauaauguuaacaauuaguguuuauugagcaccugcuaugagccagauguaguguucagugcuauucauguguucuugaauuaaauuuucauggcaagccuaagaggccaugacuguccacauuuugccucugagagacgcaaggcuuggaggcaggaaaucacucacugaaggccacagcacaaaguggggacuugagucccgaucucacugauucuaaaguccuugcucuccaaccucuguccaucugaaauggaaaagcacugacgcaguucucacucuggagcuuguuuuauuuugcuugggcugcuguagaaauaccacaggucagguggcuuaaacaacaggaauguaguuccucacaguucuggagguugggaguccuagaucaaggugucagcaggguugguuucucucuguaccauugucccuggcuuggagaugaccaucuucucugucuucacauggucuucccucugugugcguuugcauccuuauggccucuucuugugagggcacuggucauauuggauuaggguccaccauauaaugacuuuauuuuaccugaacugucucuuaaaaggcucugucuccaaacacagucacauugugagguacuggggguuugggcuuccacauacaaagucugggacacaguacgcucucauaagagaccucuucucaacaggauccauguuugauccgggggaauaaagcuagaguugcuuucuuccuuguaauauguauaaugacucaugagagaauuccccacugucuuccccaccugagaccugagaggaggagaaggaagcuuggagucgcugcccuguggccugaauuggucagugaccaaucacucagacccagcugacaggcuauacgcggacaccuuggaugugcccagcauggaucuucuccaaguaggaggccuuggagucagagaaaggugcaacucccacugcugcugcaagaacaaagacuuuaagauacugaaauuucugggcaaaguuuccucaacucuucauuuaaguguuaggccaggugggguggcucaugucuguaauuccagcacuuugggaggcugaggugggaggaucacuggaggucgggaauuugaaaccagccuggccaacguggcaaaaccccauuucuacuaaaaaaaaaauauauauauauauauauauauauauauauauauauauauauauauauauauauauauauauauauauauauguagccaugcaugggggccugcccuuguagucccagcuacuugggaggcugagacaugagaaucgcuugaaccugggagucggagguugcaguaagcugagaucgccacugcacuccagccugggcaacagagcaagacgccaucucaaaaaaaaaaaaaaaaaguguaaugcaaguagaaaagggcacacacuccagguguauaucucaacaaauuuguacacacugcaugcacaugggugacccgcacccacauguuauacacagaauaauuacaggacccugccaaccuccuccuauccccuuucagcuccugcugugaugccacuucuaaucucaauuuuauuauacaauuuguuaaauacagaaguaaauggaggcaauagugauaguaaaaagaaccaugugaauugggcgugguggcucaugucuguaaagccagcacuucgggaguccaagguaggagggucacuugagcccagcaauuggagaccagccugggcaacaucaugagaccccaucuguauccaaauaaaagcaacaaaaaaaugagacaugggggugcaugucuguggucccagcuacucaggaggcugaggcaggagaaucacuugagcaaaggagguugaaccaugauugcaccguuguacuccaucuagccugggcgacagagugagaaccugucuccaaaauaaauaaauaaauaaauaaaaauaaaaguaacagaaccauaggccuuaucuuuaucugaguuccuguagcaugugcacuacuccugauuaaccaagugaaagagaaaaugagacuaaucucuaacgucagcuuccuuuucugccaaauggaagaucaucucuaauuaauaaugaguuagaauaccuaggacaguauuuggcacacaguugaugaggaugguguaccuaguagcuaauggugaguaggaugaauaauaauacuauaccuuuugguuucugaaaugagaaaucuaaggaacuggcuuaaccaagaagcagcaagcuguuuuaauugugcuguuaggagggcuguuuguuaagguacagaagaggauuggcccauggcuuucugcuaagaaccugcugaaugucuguauagaaucccugcauugugccuccuaucaaucaggugcuuagguuugacaaguuuccuccaacagacucguguagaaguuucuguaucaacuggaaaaaaccauggugcuugggacauucaaggccgaaacuuggucccuggaugggagaagauagcuguaucauuggcagagcugccuuggucauguacccucuccagacuagacacuagauaguggguagggugggacaguuuuauguccucugccaccuuaucugggacucuuguccccugagaaguuugaaaauuuggcacauuuuaguauuugucaguguacuuccugcuucuugaugcacuuguacugcacaagaauugauuuucaggaaauaugguuuuuuuuuccuuuuugcacagcgauggguuagcaaaaugcauauuugcauagaaauaaucuuuagugagcucugcuggcaagugugucaaauuuauaaauaucacuacuauaaagacauacuuuuggauauggauuucuuccucaguuuauuucuucuuucauuuuuucauguccaggucacuacguauugcguauauuugguuggaauuuuauuuuugagcaauucacuuacccagauuguguuucuggagauuaaagcaucucacuguauuuuuaguuuuuucuacauugcaauuucaaaauaauccaacucaaaggcuguugaaaggcuccuucuguuuaagguaaagccuguggcagccuuuaacuuccuuucucuucuccugcugccaccuugguccacaguuuaucuuugaaaaugcuggguuuuaaugggcaggguauagugcagaaaccagaugguuuuaacucacaccugugaaaaugcuggggaucugcgaaacauuaaaguuaauggccagaauaaggcugccaagcucgguggaauuguacuuaacuggcauaucauucugguuaacugaacuuuccauuaacucacagaucuaucuuuucaugcccccuucuaacccccuacucaccacccacccaguuccuccuagugggcaguuugcugcugcugucuuaccuccucauccucaccccuuucaccucuccccugguaacugauuuauuuuucccucuuggaguugcuuauucuuuucuucuuccaguugcaucucucccucuacuuagauacacauuuccauuuuacuucuauuugguagucucagaacuuggcuuuuauuggccaguauauucaaugauucacuugcaccuuuaaccuuguguuguucuaaucuuuuuuuuuuuuuuuuuuuuuuuuuuuuuugagacagagucuugcucuguugucuaggcuggagugcaguggcaccaucucggcucaccacgagcucugcgucguggguucaugccauucuccugccucagccugcggaguagcugggacuacaggcacucaccaccaugccuggcuaauuuuuuguauuuuuuaguaaagaugggguuucaccauguuagccaggauggucucgaucuccugaccucaugaucugccuaccuuagccucccaaagugcugggauuacaggcgugagccaccgugcccagccuucuuguuuuaaucuuuuagacaacuggacacagguuugucuuugaaauuguacugguuuuucuugauguuuuagugcuccuggauguccaaugucauucuugggcuaguugaaggaaaguuuuggcuacccaguuguuagcugcugaaguuuaacugugcauucuaagcacaccaguauuuuauuacaucauaccugggcagcagauaauuuuaguaaaaccuugaaaagauaugacuauugggaagaaauuugggauucuauccuuuuucucuccauucuucucuccugcaccaaguuucuaagcucgugauuaaauaaauucugacccuacucugauaaaagugaacccuuguggcuggucgcaguggcucaugcuuguaaucccagcacuuugggacgccgaggcaggcagaucaccugaggucaggaguuugagaccagccuggccaacaugguaaaaccccaccucuacuaaaaauacaaaauuagucaggcgugguaguguacacccauaaucccagguacacaggaggcugagacuuaagaaucgcuugaacccaggagacggggguugcagggagcugagaucgugccacuguacuccagccugggugacaagagugaaacuccaucuuaaaaaaaaaaaaaagugaacccuuguaguuucuuccucuguuugacagauggacccuaagacggccccagugauaccccaccuccugguguccaaggccugaugugaucacccuucccccaccuugaauguaggugggauaugggagacuuacuucugaccaauagaauaugaaaaagauaauaggauguaacuguuuagauucgguuacacuauauggcaaagcaaagggauuuuggaaauaccauuaaggucuuacaugagacagauuuugaguuaaugagcagggggauccuccugggugggccugacuuaguaaggggaaaaucccuuaaagaggagcuaaaauaagagagucucucucuccauugcuggcuuugaaaaaguaagcugccuugcaguaaggaacugcauuuggcuucuaggagcugagagugcccuaaggaagccagcaagaaaaugaggacauuaguccuauaaccacaaggaaaugaguucugcuagcaaccuaagggagcuugaaggugauugaccauccccagucaagccucugaugagaccgcagccccacuaggcaacuagauuucagcaugguaagacccuggauggagaacccagcucagccaugcccagacuccuauccuauggaagcuuuaagauaauaaauguauguggcuuuaagcuguuaagcuuuugguaauuuguuagauggcaacagaaaauguguacacccuggauaguagacagagacugcaucuuucuuuggcauuuggcugcacagcaaguucuaaguuacucaccagguuucagaggagagaugggaauuugaugaucuuauaagaaaccuguacucuuuggccagacacgguggcucaugccugucauuccagcacuuugggagaccaaggcgggcagaucaccugaggucaugaguucgagaccagccugggcaacaugcugaaaccccaucucuacuaaaaauacaaaaaucagccaggcaugguggcgcaugcuuguagucccagcgacuugagaggcugagggaugagaaucacuugaacccgagaggcagggguugcagugagugcgguggcagcugggacauuaaccaaguugugaaaggagccaugauguuauuagcugagucaugucacugcaccuccagccugggcaacagagucagacucugucucaaaaaaaaaaaaaaaaaguguacuuuuugaggaaaguucuauuuuucauuauuuuccacuaugaaugaagaagaaaauaauauacauacauuacugggauucauacggacauuauuuagacacacuuccaccuacagagucacauauuguauagaauaaaauaucaucaggagcagcucaugugaccagaauguggcaaagucuuugcucuacaggucaaguugggacuuacugaggagaaaugaggggacuucaaaguccagguugcaccauccacuuuauagaugaggaaaguaagaacccacagcaucuugcacguagaauucaauauauguccugcuucuugaaucacauugaccuaacaggucauaugauuuccauuuguuugcacaacaacucaagggcaaaagugaaauuggaauuuuugcuuuugaauuucugaaaccuuguuuuauuuauuuauuuucuaaucuuuuuuuuuuuuuuuucguggaaucauguucccuucggaaaacucccugggugccccagcauuaugugguaaaggacauguauuuccaacuggcaggggcucugcaaaguuucucugccuccuuugcuaaccaaacccuaaauaauugucuggauguuccuuuuauugucaccucugaaacaagacgaagauuuggacgguuugcuuuagagugcauuaacuucuuuaucacauuaauacugacucauaucuuauuucccacuugcaauaagaaaaccauucaaaucuuucccucacaggacaauaucuuuaauagcuucuguguguuuccuauuuuuggcuguuucuguauaaacagacuaaucuaauagcauacugaacccaucuaacuuggcagaaauucagaaaaucacucauuucuauggcaagcugagaugcugagaagggggaaaaaacccucacuuuuauugcagcaagauuuuucucaaaguugccuuucaugaacauaauaugucuaucauuuggaauucuccagcacccuggcuggaaauuauuuauugcagaacgacacaauggugaacgagaagguauuauucccuguacgauuucuggcuugaauuuguuugccuaaaggagcagauaucguaugaacaugauuuugaaugcuggcauggugaugaaaggugauguucaccuggagucuguacacacaaaacccuguucauuuuaccuaaaggguaagaacaucauggcccccuucauauccugguuaauguccccgcugacccugaguucugccuccaucacuggaacaagagccugucuuugggaagaggugucuucccuggcacucguuugauuuguagccgccacacauggcaggucccaagcugucugaagucuuggcugccauuccuaagcuacuaaaacuuugcuggagaacaucaccaaucacgcugagggauccuuugacaacucagcuucaugaggacagcugcaguucugcguuuaggcuggggucaccggggucgcugccccagccccacucuuuagccucagucccucugugguuccccugacugagcuccucacuaaaggggaggaaucccuggagccuccccauccaaggccagcguguuccauuugaggguaacuggaucccugaaauucacccccacacaauccacaaccuacuacuagaaugccauaugcuuuucuauaugcuguuguuuaauuucaguugguacauauuuuauuuuuugaaacagacuucguuagaacaucuuuagauuuaaagaaaaaucaagacuguaguaccaaguucccauguguguaacagccaguuuauccuauuauuuuaacgucuuauguuauuugguacauuuauuaagauuaaauuauugauacugaaauauuagguugugcaaaagcaauugugguuuuugccauuaaaaguaauaguaauaauaauacucgguuggugcaaaaguaaauguguuuuuugcuauuaaaaguaaugcgguuuuacuucugcaguuuuuuugccauuugccaauuacuuuugcaguuuuugccaguacuuaaaaguaauggcaaaaacugcaaaaguaauuggcaaauggcaauugcgguuuuugccguuacuuaaaauugcauuacuuaaaaguuuuuaaguaaugcaauuacuuaaaacuuaaguuuuuaaguaaguuuaaguaaaauuugcauuacuuaaaaguaaucgcaguuuuugccauuacuuaaaaguaauggcaccaaccuaauauuguuauuacuuuuuaccaaccuaauauuguuauuaacuaaaguccaucguuuaucauauugccuuagguuuuuaaaaaauuuuuuaccuaaugacuuuuuuguguuccaggagcccauccaggauaccacuuuuauuuauuuuuuuuuucuuuuugagauggagucuggcucuuuugcccaggauggagugcaguggcgcgaucuuggcucacugcaaccuccgccucgcagguuuaagugauucuccugccucagccuccugagcaggugggaccacaggcaugcgccaccacgcucagcuaauuuuugcaggauaccacauuuuauuuaauugucaggucuccuuagcaucuucuuggcugugacaguuucucagaauugucuuugugaugaccuugacagcuuugaggagugcugguuggguauucuguaggaugcuccuguguugggauuuuuaugauguuuuucucaugaguuuacuggaguuaaugaauuucagggaggaagaccccagaggucuguuuucaucacaucguaucaagcauuccaccuucaucaugacucuucacuguugauggugacucugauucaccuggucaagguaguguucauuagguuucuccacugcacacuuagucuuucccucuacuuuccacacugcugccuuuggaggaguguugcugugcccagcucaugcuuguggaguggggauuuaauguucucacucuucgaggguagaguaucugcauaaacuacuuggaauucugcauggaauauuugugucuucucccccauuuauuuauuuaaucauuuauuuauaucacgguacacucauggacauuuauuuuaugcuuuauguuauaauccuauacuacuuuauuuauuuuguugcuuaaauuuuuccagauggaacaauuuggucuucaaaaguugcugcuguuggcuccuguguucuugugauguacacacaucauggugugguguguuuuuaucuuugguuuuguuuucacuucuuuuuugcuuuuugugccuccucuucccucuuccccccaccucauacauacacaaagggcagcaugcuacuauaauuucuggaaucucagccauauucuucuuuuuuuuguuuuaaauaaaaaucauacuagagcaguaggcagugugggugaguucucccacuuuacauuuuacuuugcauaauuuaggccccuuucaggccacucuucccccugugccccagguguguuugcuaccauaccuccccaggggauagcccuccaaaccugauuggccaacuagucuggucuuaaagucccaaagggaggccaucacaaacuacucaguauggagaagaccugaauccuaauuuuggcuuaaccccaaacuugggcgauucaguuuuaccuguguccucucuauaccauaguuuaugacaagggguuuucuguggcuggucuccaaggccucuuccaaucuugacauucugugauccuguaagucuuugaauaauggcccaggaugccaacaagaagucaccaaugagaguucagguguucuguuggaaaucuuuguaaaaucacagagaaaaggagaagaaaaagaauaaagaggaaaaacuggacacauaaauaggaagacaaagaaugaauguggacuggggagagaagagucauugacagggacaagaaauaaauaacuuugaugcaaauccugggaagacucuggaacaacauggaggcaccuauguuaacucuauuucauuuuggaaaaguugacuagacaaaaggugcagaguagaguaugcagugauuucaggguguugggcucugacaagaugaugccgacuuagacaguguuagucaacaucaaaugucuggaucaagagaggcaagaaucccguggauuuggcguuggccagaacuugucuggaaucuuguuuucugccuugagugucaccuguugagagcucuguugacaaacuggcauuuguccuugggagaguagccucaggaccaggggugaagaguucaguaaacuguguuuaacccaaggaaagauacagggugugucagauuuuguaaggauuuucaaggagcaguagauaguggcccuacaguggaaugaaccuucacaccgaggaucugcuuccuuuguuggaggugggaaagcaaaagcuggaugcuuggaauugucauggcugccgucugagugaugcuaccuugaguggacgguuuggccaacuaaggaguaaggccucucccucaugucacauugaguggugcuaauguuuccugaaguuucccuuucuuuucaguucaguguuucagaaucucagccuuccagcagaauccccuuuguuugcucuaaauauacauucccaagccccguguggccauucugauuuacuaggucugggguugggggauugugggugccgagaaucaguauuucuaucaagcucccaaggggaccugauauauacauggagcugaaaaguacccaccuaacagacuugccagcuccuuaaggauaagaacuauauuuucuuccuuuuuuuguaugccuccccaugcaaggauaauuacacagaauaagcacugagaugccuguugauggauuuauuccagcaauuuuuuuuuuuuagcucucuuugucuggaacuuugcaaaauaaacaccauggucacuccgugcuuugugagugacgugcuagaauggaauuucacuguuuuaaauucaggguuaauuucuugcuuucaaaugaauuaugaaaggaagaggagagaccuuuggaaaagucugaauguugaugccgacgacuagccaggcgcuucccuuccagcugguuucgugagggauuaagaggccacuguugugaaucucccauuagugauggucccaggcccccuccucauugugcauuuaucuuacaagaggcauauuuaggagauguuuccguucuauuuuaucugcagaauuacuuuccauucucaggucuuuuauauaaguauucccuugaacccguuccaaaaacuggauuuuuaacccaauagaccauaacugcaguguuuuauugugcuuacauauuucaaaaugugaauguaaguagauuuagcaaaguuaaaauaaaaugaaaacuuuucaaagggcaccacugcucgcauucccauguuggaguuuucccuuugggguucuuaugccauuuuaaagacucugaaaacaggaagacuuuuucucuuggguauuuuauuuuuuuuuccucugcaagggauggggucauaagacauuggugagguuaggccuuccuuugucucccaggagcacacuugauagcaauguagggugaauuccaaaucugugaguuagugccguauauagcaguguugucaguaagauuucucacuggcaucucugcuuccccucuugacucucuugaaaucccuucuucaggcagaagcuggagucauuucucuaaaauagaaaucugaucuugccaccacccuacuugccacucccugcuuaaucccuucacuggcucaccauaucccuuaggauaaaauaacaaaauccuuuccagggccugcaagaccccugccaaccucugcagcuuacuuuguaccacuuuccccagaaaccugcuaccuacccugcuccuugccacagggccuuugcacaggcucuugucucuggcuagaguagucuucccauccugcuuuagcuaaucaacucuuucucaucauuuaggcuucaaauggaucaucacuuucucuggggugcaggggucuuucauauaaguauuucuuugaacucauuccaaaaaaguggauuuuuagaaauagaaaaaacuaauuuagaaauagaaaauuaauugaguuuuaguuuuuagaaaauuaucuaagaaguagauuuuuagaaauagaaaauuaacguagaucacagaaaauuauccaaacucaguuaauuuucccuuuuccagcaacuguauuuguccuccccacuucucuucccugccuucuuuuuuucuccuuagcacuuacaaugucucacucauguagacucgaagcuucacaagggcagggauuuuagucuauuucauugaaaaucugucaccagucacuggcccagagagaguccucaaaaauaauuguugaaugaaugaaugaaugaaugaaugaugauggcgugaugauuguguauuccucaucuggcuguaaguuucacaaggccaggcacugggguccuauuuugcucacuguugcugugugggaaagaguuaguacagcagacugucgcaagcuuggcucuuggcugcaucugggaacuuggaauuuaggagggcugucaccauucccagaucagauaaagauggcucacucugucuagacugcuuguaccaaaaauagggcucauguggaauaccugcuuuccuuuguggaggcuggaauuuuguuauaugcuacagagagggugccuacguggccaacuuccaauaaaaacuguggacacugagucccuaauacauuucucugguagacaauacuucauauauauuuucacagcucauuucugggggacuaauuaaaugcauccugugugaccccacuggaagaggacauuuggaaucuuguaccugguuuucuccagacuucgccucauucaccauuucccugugcucauuuugccuugcauccuuuugcugugauaaaucucagccaugagugugaccguaugcugagucuuaugagucuuccuugcaaaccaccaaaccuggguuggcguuucagugccugacacaguuguauuccuaagacauaguugggaccagaccucaagaaaauagccaacaaauacugggugaaugaacgaaagaggccauaugcagucagccccccucucucuggguucuacauauguagauuuaacuaaugacagauuaaaagcauucgaacaaacggagggugguaucuguacugaaaauguaccaacugcuuuuuuuugucauuauuccuuaaacaauccaacauaaccacuauuuauaucguguuuauauuguauuagguauuauaaguaaucuagagaugauuuaaaguguacaggagcaucacauacauuauaugcaaauacuauacaauuuuauguuagggacuugagcauuuguggauuuugguauuuggggggguuccuugaaccaguccccuuuggauacugagggacaacuguacaaaucacauuuaggaguggaugcaggucagucgugacaucucauccaccccuuccucacccaagauucuccguggcuugugucaaggccucaccacaucagaauauuucugcucaugguugcugagacagagcuggacagguccagcauccauuccccaaaacagaacucaaacugacgaucaucaagauauuccagcuauggcaaacugcggaagaauuaggacagauguaugacuuauuucauauaaagcuaaaucaguuuaauuuauaugauuguccuuuauuaugagauuauguucaacagauauuuucaguguuaaaauauucuuuuuuuuuuuuuuuugagacagggucuggcucugucacccagggucuagcacaguggcacgauuuuggcucacugcagcuuccuccucccaggcucaagagauauucuugccucagcccuccaaguagggcuacacgugugugccaccgugccuggcuauuuuuuguagggacaggguuucaacauguugccaaggcuagucucuaacuccugggcucaagcaaucugcucaccugggucucccaaaguguugggauuauaggugugaaccaccauacccagccaaaauauucuuuucaaagugauuagaaguaggagaagcuugcucucuuuuuauuggcacuucugucuuacaugcacuuuuugauuuaaauuauucugucuucuaugaaaugacagugauuggaggugguuuauuuuuuuuuaagucugcuuacucggaaaaauaaaacaaaguugacaaccugauuucagaccucccaauuuuuucuuaaaaaaaauaaaagucuucuugguccaugaaauccagaaacuggagaccaaacuagcaaauucgcaaggagcugcuugauagaaaaacacuugagaucaagagucagaaauagcuggguugaauuccaguucucucauauuaagugacaaguugcagaaugccccugucuuucugagcuguuuuuauaucuguacaaugggguuaauacuacuaguauuugcuuccagggauuguuuuggaggggagugaggaauaaaugauauaauucacuaaaacacguagaauaguauuugacacagaguaggucagcaugcccaaaguaucagagucauuauugaguuauuccgcuaccuccguauuugaguccuuucuuuugggcuuuccuacuuaacgucgcagauguuauuuuuuugaagaggguguaggccaagaaaggggugggagaaacgagcaagguguugauagaaccccuuaguguccuccucauaccacagacacucucuucccccacuuacuuggccaauuuuuuuuuuuuuuuuuuuuugguggagucucguucugucucccaggcuggagugcaauggugcgaucucagcucccugcaaccucugccucccauauucaagggauucuccugccucagccucucgaauagcugggauuacaggugugcgccaccacgcccagcugauuuuguauuuuuaguagaguugggauuucuccauguuggucagacuggucucgaacuccugaccucaggugauccacccgccucagccucccacagugcugggguugcagcugugagccacugcgcccggccuacuuggccaaauucuugccugaucgccucuccaccccugcuacguguaauagaaagguagggccauguuggagagggauccaacauuuauuauccccauuuuacagaugaagaaguuaagguggccaggcaugguggcucaugccuguaauccuagcacuuugggacacugagguggguggaucacuugaggucaggaguuugagagcaaucuggccaacauggugaaacccugucucuacuacaaauaaaaaauuagccgggugugguggcgugugccuguaaucccaguuacucgggaggcugaggcaggagaaucgcuugagccugggaggcagagguugcagugagcugagaucgugccacugcgcuccaugcuaggugacagagcaagauuccaucucaaaacaaaacaaaacaaaaaaacaagaaguuaaggauugcagagcauaaguaucuucuauggggcuacccaacuaggucgggacagggcagggauuugaaccuaggagcucuuggauugcaauuuuucauucaccccucccucuccacccuuccugucuucaagccugagcaggugauacugcauuuuguaccguaugacuuuaaaacagaaccacgaguucagaacuuugguuagguccugcccguguucucuagcuaacgcauggcaacgcugguuuccaaccuuucacugugcggguuucugaugaguacgcuggcaggccucuggcuucagagaugccacuacaaaggucuccuccuuuucauaaacauugcugcaaggcccgcuucucaagaaagcaacuugugcuaccuccugcgugcuuuuaugcuucgcugugaagugcaaaguugggcuggcaggccuggcuuucuucuccgacuuauguaugauucaucaagaggacuccaggcuguggugugcggugcaacccgggcuguguucccgagugcaucaaacggggauugggaccuguuuuccuucccacucacauguaggucaccuacgggagcaggggaggaaccaucugagguguuuuuuuuuuuuuuuuuagauuucucauugcugagaacaguuccagcucugccgaccaaaggcugaguguccuuuuauuagucugagccccuagagagaccaaagaggcaacccucgagccaacugacagccagcugugggguuggacccuguuuuucauacagugagcacucuugaacccagagaaggugcagguuggagaugcagcuauaugacucuguaccagagagagaccuuuuuguacauuuggaauaaaaauuuuuagcauuagagauucgcuuuuuugugucuaaauacaaauguccaggagaauaggaaugccauaguggugagcuaagagcaggcaguuaguuaaguguaugacaaguaucucauuauaaauggaugcugaaauguccaaguguggaaaugauacgcuucagcucuuauuuuuaagucauccuuaucucuuucacuuauucccucauucaggcaccaaaaaugcuguuugacugggagagcaaguggagcuguucaaaguuguagggacagccgggcgcaguggcucaugccuguaaucccagcacuuugggagggcgaggcgggcagaucacaaggucaggaguucgagaccagccuggccaacauggugaaaccccgucucuacuaaaaauacaaaaauuagcugggcaugguggcgggcgccuguaaucccagcuauucaggaaguugaggcaggagaaucauuugaacccaggaggcggagguugcagugagccaagauugcgccacugcacuccagccugggugacagagcaagacucuguguuaaaaaaaaaaaaaaaaaaaguucuaaaucaguggauucugccgauaaacaucaucuggacggaaugaagcugagggccaauaguuuagaggcucagcacccgacuggagagagagagagagagagagagagagugugugugugugugugugugugugugugugugugugcgcgugcauguguauacgcugguguuuaggugggcuugagaaaagugcugacuuugugaacgaggaggagggaaaggguccagagcaguaaagagccuguaaauaaauucauaccagcuucagccccaugcuuucguuugggauuccucauccaacccugacggcuucccugcgggacauauuucccccucuuacagauaggaaaccuugcccaaugugauuacgccaggaagucagauuucaaaucuaaaugugccuaaugccaaaacuguaccucuugccacucaacaucugcagucaaaggcuuccugacucaggauuugcuggggucuggcucugggcuauuagaauuagaugcgugagacccuuucaaucuaaaccuuaaguauuuugccuguuggacagaugccugguugucccuuuaauccaucgcccaaaaagccugaggaaggauggcagguggacuuggaucuaggccacucccuuagauccugauuaggggaccucugcgacugcucaucugggaggaacuaggggagcgcuaauguguuguccuugacugggcaagaagggaaggagaauugugaaacaugcacaauuagaagucgugcaccuggguucauauccuggcugggccacuuacuuucuggcggguggggagggcagacaaguugcucauccucucugcgccucaguuucuucaucuacaaaaugaagauguugguuauuucuuuauucaaggguuguugagaggaugaagugcuaaaaaugcuugaccagcauucacacaggcacuaagacggugaguacucacuacuuagcgcugucaacaucaucuccguccacaucaaugucgucaucguccuuaugaaaagcccugggcaucauuuugcccuugagcuggauguccauguuggaaaaacagcuaguggaaggcgugcccaaaucucagaaguuggcguuuccuugcagauaucauugguggccauuggaggggaaaaagaugcuuuggaaaccaggacacagagaaaagugccucguauuauacagagccaagagaggucacuguggaaguacagaggaagccuuggccuaauugcacgguuaauacaauuccguaacucauccugccaacacgaagguagauggacgguccuuaugcucgcugcggaacacugccuguguuuuccuaggagagacaucugcacucuaguagugauuaaaaugccuuugacaggcucuugcuauuaagaguuucuggcuccaguuuaauaaaagguaguauauuauaauggaaaccagguuauuauugauaaggacuagacauauuagagaccagguuaaagcuuugauagucccaaaugcaaggggagggagcuaaggguuauugcaaaccuacugugugucaauugcucuaccagacaccucagagacaucacagccaaagacccccaccuuugaauaaaccaaguuuggccucucugauauauuaauauauuuaaucaucagacuuucaguguuaaaggagauuacaguagaggcauccaguugauuggggaauaguuguugcaaaugauaagcucuuuugaauaaacugauacugacuuaaugagguucugcuguguacuaucuuuuuuuuccuaauagaaaauagaguagcugcccuccccauccgccauucucaguccuuuugcuuacuaguaaugacccucuuuucucucacuccaugggaacuuuuaaaacugauaauuaauggauuuuuagccucaaguuucuggaauucuaagagggccugaaagguaagugcucacuuacugaggugugugaacaaaaacaggcaaccuagcucagcaaguaagaauggaguggcaucuccccaccugcucuggagucauguguuugcuucuggaagggaggcaagaggcauucaaccuccuguuaauuugguugcuccuucagauacgcucuucaugguacagcccugagcugcaucauuuaaagaccaauuguuaaggaccaaucugagggccugugcauuaguuaaaacuccuuaucuggucauagaggguggugugguuuggacgcguuccccuugucugugcaauucccaacagaggcaagugcgcauuugagacagguugaggguucaagcuguccaaucccugcucaucugcagcacaccaaggaauguggacuaaugaaaaauaaacugcaugcaugcaaugcccaucacacugccugcauuuucuaaucuucacaauaacucuguguugagaaauauuccugucuguaaucccggcacuuugggaggcugaagcgggcagaucaccugaggucaggaguuugagaccagccugggcaacauggugaacuccccccaaccaacgacccuucccauaucuacuaaaaauacaaaaauuagcugggcauggugguggggaccuauaaucccagcuacuuggaggcugaugcagcagagucuguugaacccaggaggcagagguugcagugagccaagacagugccacuguguuccagccugggcaacaagagugaaacucugucucaaaaaaaaaaaaaaauuguuucuggccccacguuacagaugaggcuuuuaaagauacccagccaaugguccacagugauguaacucaucagugguccaccugacauuggaaauucgguugcuuuggaaccuucuacuacauccccuuuccuuacucacugacaucauucccagaucaaagaaagauaaaagaaggaagggcuggagacguuguuuuccuguaugcuccuugaugaagggcucagagcuaagcgcggaguaggugcuuaagcccuuccauuugaaaggagcuuuaaacaccuuugguggcagcuaagagugucaaaauggagggauguguaggggaccuagggccuggguaacauugucccaggccagggccuauuguguugugugugucuccacuuuccagccuuugggaacgcagagggggaccucuguaauugguaccagcaucccuuccuugcaggguccguccuuccucugaguugggggaaggggucuccaugguuucuucuaccagguagacccagaaucacuuucaacuugcucaccugucugugcaguguuugaguucuucccugggaagcuugcucacaucauccacuucucucuggguucuccguaccgcuuuccccaauccaagcuaagcucuucucuuaguuauucuaauaacugcccaauaucaggcacuacccucaacacuguuucccauggcaauuauuuuacaugacaguuuaaaaaacaggaaugcucgauuuguauucccauuuugcagacaagccaacgaaggcuuggagggguugaauggcccaaguuuccuaaguggccaggggcagagucaggaucugaacccaagacauaggcccaggagucuguguuuguucuuuaaaccucucuauucaguugcccagcucuuuucauucccuguccuuucccccucuggcugggucugccuuuccaaccgcuaccaccuuccaccaccauuuuuuuuuuguuuccucugcaagcaacaucugaaaggcccagacccagcuuguuggccuugggcucugauaagaucugucugcacuccuuuugucuggccuguaccugccuuuucugaaugacccuguuaauugcaauugacucucauagaauguggauagcagugccacuugacaccagacuaaugcuucugacuuuuccauggugccccagcagcaggcuggagggaagggcgggggcggucagaggagagauagagcacuucagauuccaaucgaauacauuagagcauuagagcuuuucucuuccucagggugcucucucucucuggguugggaggagauguggcauuucuaggaauucacaguaaaaucagaaauaauuaggagauuucacaguuguagcuccugugaagauucaggaauuuuuuuuuucuucuauuugcaagcuuuaguccuaggcauggaaaaagaacuuugaagaaaaccugagagauaucaguguaaaacaagagaaugauucccucuggggugcugguagugggggcuuaauuuccuaaaggcuuacuggguaucagggcugcuuuccuuuauaaucuuuuacccgucuuaugggggaugaacagaaacacacuuuagugcuagaaaagcugggccuaaaagaccagucuccugucccauacuuggacauuuauuguucuuuuugggcaaggugaaaacuugaaaccaaaagucuguugaguuuggaagacuugacucccaggauguacaaaguacuucugcaugugcgcaaaguccuguaggcccaggcaucaaugacacaugcagugugggcccaggcaucgaugacacacgcagggaagcaacccaagcugggucaguccuuacaaggagaccggcaccugggcucacaccuugccguauaugacuucaugggaaccucauaacagaccugugggcucagaauuauucucucacuuugcagaugaggaaauggaagugcacagaaggaaaguaagaguguuugagauccuguaguggguucauugcugagaauaaacccggaguugccucugggaggaccugguggugggugggauggagagagaggccuccccucagacuccaggggcacagauuggauuuuuuuuuuuuccagacaguuucacucuuguugcacaggcuggggugcaaugguaugaucuuggcucacugcaaccucugccucccagguucgagugauuuuccugccucagccucuggaguagcugggauuacaggugcccgccaccacgcccagcuaauuuuuugucuuuuuuaguagagacaggguuucaccauguuggccaggcuggucuugaacuccugaccucaggugauccaccugccccagccucccacaguguugggaucacaggugugagccaccaugcuaggcccagauuggcuucugugugaggaugaagaguaauaggaagauagaguggugaucuaaugucaacuguggagggagugggaggcagguguucgcagggcacagcugguuuccuuuuugaaucccacacagugcuggggcaguuucauagccugugaccacacagauaggaaagugacacagcaacaccaggcagauucauuuucuuuaaaugagggguucaaaauagaaacacaaagcauugaguauugagaagaaauggaucuucagguuuggagggaggccgauagagagugucuggaguugccaacguccucuccuugggucauggguguguguguguguguuuucuucuuguuguuggguuuuuuuuuuuuuuuuuuuuuuuuuuuuggcuuuugcgccuauggugacuuuuagcgaauggauacuauugaaggaauguuucacuuccaaauccagaucucugacuucccuugaaaauuuggagugccacucaagucggccgcucugagcuagaauccugguguucagaauuggcaggaagggcacaggggcaagguauaggcucacgucuccacauucugcaccucccaggcuccugccauugaugugagcggguuccuguacugcaugaagcagggguuugcauccgaaacaaccacccgugcugaauauguaggugauacguugaucuguacagcaaaccaccauggcacacauuuaccuauguaacaaaccuacacauccugcacauuguacccuggaacuuaaaaguuggugaaagaaagaaggggccgggcaugguggcucacgccuguaauccuaacauuuugggaggucgaggcaggcagauugccugagcucaggaguugaauaccagccugggcaacacggugaaaccccgacucuacuaaaauacaaaaaauuagccgggcguggcagugugugccuguaaucccagcuauucgggagggugaggcaggggaauugcuugaaccugggaagcagagguugcagugagccgagaucaugccacugcacuccagucugggugacagcgcgagauucugucuucaaaaaaaaaaaaaagaagaagaaaagaaaggaaggacagauggaaggaaggaaaagggaagggaaaggaaaggaaccagcugcaaaaauuguccuaacugagcauuacuguaacauagaacagcugaaacacuccucaaagcugagaggaggguuugggagagaagcaggcugugguugugaacaggugccuccuccaaaaaaauucucuuccuuggauuucaaaaugacccccguugacaacaaagccuuucacgcuguguuuauuuuuuuucaggucuaaguuucccccaggagauuuuuuuuuucuaaaggaaaaggcagagaagcccccagaccggagccacaaucaaaugcaaauaugacaauaggacccauccuggagagaaaaagccuucuuuuuaauuagaagccuggaaggacauacccuuuaauugcugcacuuguagugucaggguuaucaauauccguggcucuuucauuaauaaacuggcgagucagaaagcagcaggagugggaaccucuccccacccaauccccucucacgccccaagcucuauuuaaucaacugcagacucaaucaaauggggaaaagaacauguaaaucagcucauucauucugcuggcccuaaauagguagaaggaagggaaacaugaaagggagccuucaucuguuuuccugcagaugcccggcucgugguuaacccaagcaagagguaguuaaacggccccgcagauugccagugacuccgggaaugccuagguuuauguauggauuaacacagugauagacccugaguagcaaaagacgaagacuaauuaccugacagagcuccccuccacucgccugggucauugaaauuaauuucugcuuucaagcuuggcagaaagcagcugcagaauuucaguucaauacuuaaauuaacggggagccgaaauuauuucugugcacaggcaguauuagaggaguggcuuaccaaauagaucuugaucgcagacacggaaaaaaggauuauuccuccccuuuuaucaagagccguaaguccuuggaaaaugcaaagagggggaaaaagaagaaaaacagcaacgaguuuauuggagaguuaacacuuaaauacuccaguacauugagugugacaugccuguguaggagacugucugucccccaaauaauugacaauuucucuccaucuaacaagaaaauauauggcacuuuuauauauacuugaauuggaaucccuaauccagagauaauuugugaauauccauucuauagcaucccauguugucaagaagguguugacuuacugcaagguuaaggaaauggguggagaauguagggaggagguggaggauaaaggauaggacuaggaaucagaguugggauuugaacccagggcuucugucuccagauuccuuguucugucccuuuaugcugacuuuccuuuuuugcucaaagucucucuccuugcuucuuucucuuugggcucccugcuuuuauuucggcccugauggaaucugucgacuuuacugagcuccauguaugugcaccaggucagauucaaugcugccuagguccacaguccucaguuauuuguuccugugauuuucgcgccaccaggagccacuuguuggaugagauuuccgggcaaguugagucuccauguuuuugucgugggcuacugccagcugagauauggaugaagacucccuuucauguuucccuucuuugguguccauggcaguucccaccucgaccgcuaugguauuucuuuugcuucugcugaggcugugugugggugcacaucaggauaccucaguggggaacucagggcgugaggcacacucaugacagaugcaggaaaaacaucucuuuucuaacuguccagcucuuuaggauuaggcaauacuuuaauaaucaaccaaauucuggaauccuacugccaaauuauggcacucauccuacuugguguaaaauccugggaugauagcuuauaauaguaauaauaagaccugcuucccggugauucucuaaggauuaaaucaguucauggagaugaaauacuuaaacugugccuggcacaaaguaaauguuagugcuacuauuaucccugcugcuguuaaccccaacuagauaagccaagauaaggugcucuccauuguuuaccugaacaggcagaaaagcucuaugcagcuauccagacccaagaggauccgacagcucuggaacuuguaauauuugcagcaugucuugcccucuuaaugucuaagaagucaaaaaaggacacguaugccuagaaaacaugaauaauuaucaucuaucaaauuuuuaccaugugccaagcauagucauauuuggcuaacgaaaacaacaaaaucaaccgugacaagguuuuauuaguaaugaaacugaggcuucuggaggaucuguaacuguugcaaauuuccaguggcuaguucagggacagugccggggcuugaaccccugucucugugucucccagcucauaaggugugcuaccaagucacccaugaguagcaauuaggcgacuucuaacauguccagcuuuaaaccugugaccucaaggcaaaugacuuccacaucucauuagcacuccccagagccuuccagcccccuguaggagagggagguuaaucagccacgcgcugaaucugcuuauaaggcuguuucauguaugauuuuuauaucuuggcuccuaauaauggccccguuguaaaugauugucucacuaugauauacggguuccuuaccuucuaggaacugauuuaaaaggaagcccuagacuucuugugccuguagaguuuauucauaucacucuuugcuugcucagcaguugaaaugggauggaggaaagcccccuaacuccaaaaaaaaaaaaaaacuuucuucccagccugagacaguugccauaauuaguaaccugcagcucccuugauaucuugaugauacuuuauuaaaacaaacaaacaacaaaaaacacagcugggugcgguggcucacgccuguaaucccagcgcuuugggaggccaagaugggcagaucacgugaggucaggaguuugagaccagccugaccaacauggagaaaaccugugucuucuaaaaguacaaaauuagccagacaugguggugcaugccuguaaucccagcuacucagaaggcugaggcgggagaaucauuugaaccugggagguggagguuguggugagcugagaucacgccauugcacuccagccugggcaacgagcgaaacucugucucaaaaaugaaugaaugaaugaaugaaugaaugaaauacuacuucucccuguccuccccacccuaagcaucugaucagacagguagugcugguggacagauggacagacaccuaccccauaugucaccucccuccucuaugcaaacaaaaauuuuaauuauuucuagaaugacuuaggagagcaagucaugugggauauauagcgucagggagcguauuuucaaaccaaaaaccugggcccuuauuuuuuuuuucuuuuugagacagaguuuugcucuuauugcucaggcugcuguacaguggggcaaacucagcucacugcaaccuccgccuaccagguucaaaugauuuuccugccucagccucccaaguaccugggauuacaggagccugccaccacgccuggcuaauuuuuuguacuuuuaguagagaugggguugcaccauguuuaccaggcuggucuggaacuccugaacucaagugaucugcccgccuuugccucccaaagugcugggauuacaggcgugagccacugugcccagccaaaccucggcacuuuuauccaacaaauauuuauuucgugacuauuaugagucaggcuuaagaauacacuaguagguacagcaggagagcauguagaagaggauagauguagaaaaucgggacggcauguuaggaauauagauaggaauuacuaaggaaaauuguauuuuuguggaauucuuugaacucguuacuauuaguaaacggugaguuuugguucuacucuucaaugaguuuaagaugaaggaaaucauuaaauagugcuuucuuuucuucaaaaguuggguugcauugcauaguuaaaguucuuuaaauucuucucuaaaccccaaggcuaagcaauauacaaucuaguuacaauggucugcuugcuguuaccagaaucugucaagcucuuuccuaucgaaggguuuuuuccauguacugguuucucuccugcguggucuuguucuacccuugaggaggguaccaccuccucauugcuuaguugucaguauaaaugcuccuuucucagagaggcccauccugaccaucuguguuuuuuuccuaucaaugcuuuaacaaaugaccacccauggguggcuuacauaccaugaaugucuucucuuaccauucuggaggucaaaaguccaaaaugggucugucuuaguccuuuuguguugcuauaaaggaaugccugagcugggucauuuacaaaggaaggaaauuuauuugucucauguuucugcaggauguccaagaagcauggugccaauguauuucugaugagggcgucaggcagcuucuacucaugguggaaagugaaggggagccagcauguucagagaacauauagggagaaagggagcaagagaggggaggggaggugccagagacuuuaaaagaaccaacucucugggaacaaauagagggagaacauuaaucuagccaugagggauccacccccguaaccuagacuccugucaucagccacggccuccaacauuggagaucaaauuucaacaugagauuuggaagcaacagacauccaaacuauagcagggucuccuugggccaaaaucaagguguuggcagggcugggcucugggggcuucuggggagaauuuguucugacuuuuucgauuucuggaggccaccuguguuccuuggcugguggccacaucuuccauccuuaaaaccagcagugcagcgucuucaauucugucccuggcucugcuccuucucucccccuccucucccccuuugucaucuuuuuagguuuauuugugaccuuuuagauccuuugugacugcauuggucuuccuuggguaacugcgcauacucuccucaugucaagaacuuacaucccucuacaaagucccaucugccaugccaaauaacaccuuugcagguuucaggguagagcauggaugccuuuugauuuugauuugguuguuuuugguagagaugauaucuugcucuauugccaggcugaucucggacuccugggcuccaucaauccucuugcuucccaaagugcugggauuauaggugugagccaguacacuuggccuuuuggcaccauuauucugccugccauccuguccuaacuaaagaaaguaaggucccuccauccuccaucuuagcccuucuuuccuuagccuccuaacacucaacgcaauuuauauauuuuaauuuuuuuuuugagacaaaguuucacucugucacccaggcuggggugcaguggcgugaucuuagcucacugcauccccugucucccggauucaagcaauucucuggccucagccucucugguagcuggaauuacacguauguaccacuacucccggcuaauuuuugucuuuuuaguagagacuagguuucaccauguuggccaagcugaucucaaacuccugaccucaggugauccgcccuacugggccucccguagugauaggauuacaggccauugugccuggcguauauauuuuaaauuuuauuuuucaguuuacuugguuuugccuccuucuagaacuagaacauaagcucucugaagucagggaccaugccuagaaucgccuuccuuuuaucucccaucagccgaaacuaacucugcugugucacgcuguguuaggcuguguuggcugugaguaagagaagucucacccaacuagcugaagcgagguggguuggaggggggaugccuuguggaagugacaacucuaggcacguaacuggcucagacucugcugggcccagauauacagaugucaucaagagucuuucucuuccuuuugagcccagcucucccuuugugacccagcaacuuccuuccccgaugauggccaagccuugaggaugugaaacugcccagugccccaaucuggaguccaccauccugggucuagcuggggacauccuugaaucagccucugggaaucacugaaccaacaugagucacuugcuacugugagaucucagaacacauggaucaggacagagggcagggcuguuuccccaaggaaauccaaaugcuuuacaggaaggggaguggaugcuggcccggcccaggcgaggaugaggaguaacugagcugcagaccauuguuuagcccuccuuccaccugggagacuggcugcugguucucauugcuucugugggucuccagguuucuaucauuacacagauuagcacacgguuccaugaucauggacccguucaguacacaaugaaaucauuugcaaagcaccuuggggucuguuagagaagggaauggaugucugagguaugcuaagccuaaucuccaucuucucaaagcuccacugccacugucccguaagggugggcagauuccuccccauucuauaaaauaacagcuaccauuuccugagggcauacugagugcugacaggcacaucaacaucagaccaucaccuucuuauaccucaaaauagucugcagggugacucagaagcuccuggcugguaaguggcagauccagagaugaaacccagaucuaacuggacccaagacagaaauuucuagaacagaagccacaaacguguuagcuaagucugguuaugucaaguggaauauuucuggcuuugggggaucccagcucuuuuuuucucucucacucugaguauuuagaggcuuuuauugcuauuuuucuaaaaggcaacauuaguaaucaacuuugccaaaaauuucauaugaacggugggcuuuucuuucucauuugcuuucgcuuaguauuuuccauuauucauuuggcuucuugaacccucccuaucuguaccccacacuuacucuuauucacccagaacaggugugugccaccuuggagaagaugaagccagagagaaaaucagucagacaggaauuauguugaaaggugacugaauacauuaccaccucccaggaguugaaugaaaaacggcuauuucuuuaggacgucaaaccaccuuuuuccucucuaauucaugcauaucccuauacaaagacccaagguggugaggggcugguuuuuagauagucuggaggcccucugagaaugcgaggcccuuguuguaaggaaacgcuggugggugcucacuccuucaucaggagccagccggcuccccugcacuuacugcuuuggggaagaguuuuugucaagaucauuuuugcagaugguuguaagguaaacagucacuggucccuaggauaucuugcuaaugagacaccaaagauacacauggacaauggccagaccauauuuugucacagaaugccgacccacaagcucuggagcagucaacucagaauggucaggacuuggucaguaaugcccauuuuugcuaaauuuuguccccacuuccaacgcaggaccaaccagagaaagccacauaugcuccccaaaccaaucauacaggauguccuggucuagggagcccaccuccggcuuccccauguccacagccuccaaucggagcauacuggaagucauccacuuucuuuuuuguuuaaccauaaagcuuucuuucucuccaccuccuuugagccucugccaaacacaacugaugguggcugacugccuggcugcaggaaguucugaauaagugaccucuauuuguuauuauuuggguucccuuuguuuauuuuuacacuagcuuugcacuagguuaauuuuuucccacauggcuuuuccuguuuguuucuuugauuguuuuuaauuaauaauuaguuugcuuauuuauuuguuuauuuuuugagagggagucucgcucugucacccaggcuggagugcagcagugugaucuuggcucacugcaaacuccaccucccagguucaagggauucuccugccucagucucccaaguagcugagauuacaggcgcccaccaccaagcccagcuaauuuuuuugguuuuuuuuguauuuuaguagagacgggauuucaccauguuggccaggcuggucucaaacucuggaccucaaaugauccaaccgccucggacuuccgaagugcugggauuacaggcgugagccaccgugacugaccuguuuuuaauuuuuuuagagacagaguuucacacuguuuaccagauuggagugcaguggugcaauccuagcuuacugcagccuguaggucccgggcucaagcgaucuucccaccucugccacuugaauaggugggacuacagguggguaccaccauacccagcuguugaaaaaaaaauggugggguauuacucuguugcccaggcugguguugaacuccuggccucaagcgauccuccugccucggccucccaaagugcugggauuacaggcuugagcuacuuccccaggcucuucccccguuuguuaauacauaccaugaccuuggccuuucccaccucuuagguuuugcuuacuuucccuucuguccuuuacuuaugacucugcccccuuuugaccucugcuaaaauuauuuguuacuguuguuauguuauuauuucauguguuaagucuacaguguauaacuuggguuuacuuaucucauuuaacccuuaggaaaaccuuacacuuaaauacucaaagccuugauuuugcaggucugauugaugggcauacagaggaauuaaaugaccuugucuuccacauaugguauaaggcacaguaguggaagcaggauccaaaucugugucuguguuuggaucaacagcccuggccaccaucuugauucauuucucuuaucuguaauucuauggagggagguuccauuguauauuuuuuucuuucaauuacaguauuauuuguauauuggaagccuauuguacuuuaucuguguaacugucguagcagcuagaggcuaguaggacuggcugaaaugucagaggaaggagggaagaaaagggagaaaagcaggacaaaugaacgcagauuaaggaaaauaaaaaagaguguuuggcuaacuugcauaaaaaggaucucauuuuucuuuguaacacauuacuacauacagugaccauaguguuucucuaauuucuucaggacuuacuuugaagaugaagaaguauguguauccgcuuuuugucuuucagaauaacauacugcugucuguaaaaauacagauaauuucucucuuaaauuccauaagcuggagacacugccccuguuucaaaugaauacagauucauuuugucaccugugugaaauugguguccgugugccuugcuuccuaggcuguccaccaugacaucagccugcccaugcaaugcuugagauuugcccugugacucaacccaaaucuaaagcccgagucguaugaauccaggacaccugccugcaaaugcauuuuucauguauagguuauucacucuggucuuugagauuauguaauuagcauauguugucauagugauguauuuauuauaauggagguguucucaggaaaccagauuuaauacuuuuaaaucagaggccaacauggacuuuuaggaauuccauucacaguaaauuuuaugcguggugaaagguuauggaauggguuuccaugccaugucucccccugucccacaaaucucagcuggccugcaaagguuccacuguggauuuuugccagccagccacgcugauguagacagaauauuucggauuuauauuauugcuuacuuggcacaucuuccauuggaaauggaauagagaaaagguggcuuggcuguuugguuuauguccuaaaaccuuaucguaaugugauucuccuuaacagagggauucguaagcuuaggacugauagagauuuggcuuuucugcuguuggauugauagcuccuugacugcugaagccauugcccaucuguucaacuguuguauucacgaggagguuagaccccugacccaaggcccagguaccuggcuuuccucaguugggaucagaaggccacaaaguuuucuuauauuuuaagcaucaaaguagcaccacuguacagcaucuuuacuuaaucugcccucuuucacgugugugcaucccuggcaugcuuaaacaagaaaggcaaaugagagagagcgagugagugcgagcgagagagcccugaggugccagaaggcugugguuccuuugugucuacagaaaagauauaacgauugaauuagacucuuaaauaucuguggaugucagguugaauacaagcagcuauucaguguuuuacucuggcaggagaacaaguccccuggaggucagaagccaugcaggucccuggaagugugagcagauuguuaaaaugguaucaaagaugggcuggcaugaggccagagucuauccuugaugcucaccugaggucuagggcuaaacucuugccuuuaccuguuccaugcuuagccguuccugcuuuuugccuagaaccucagugcuauugcucacacagacccagcucauguccccaggccaugaccacugccuccccuucucccaccugugcagguguuaagcaucaguacauaacugaggaguaggagggcagcagcccaaaucuuugaugaagaaccucuuucguaucaacuuaugcuuuggaacgagacacuguuggaugggaaucuggcuucuaacaaacugauugguuggacucaugccuuauucuuucggagccuuaguuuugucauguguagaauggggaguauugcuagcuauucccauagggagugagagagaguguaaguaaaaugcaauggcaggcacagggaugguugccauuaucaguuacauuauuaugaggauuauuuucuaccuagaucagguauaagguggauguauuauuggcauuccuaggacuguuuuaaaggaaguaccuaugaggccucaugauaagccagauguccagaagccagcuugagaccagggcuccuggucacuuaaaagauguuuggggcugggcgugguggcucacaccuguaaucccagcacuuugggaggcugaggugggcagaucacgaggucaagagaucgagaccauccuggccaauauggugaaaccugucacuacuaaaaauccaaaaauuagcugggcgugguggugagcaccuguaaucccagcuacucgggagccugaggcaggagaaucacuugaacccgggagguggagguugcagcgagucaaggucacgccaguguacuccagccugggugacagagcgagacuccgucucaaaaaaaaaaaaaaaaaaaaaaagaaaaagaaaaagguguuuggaagccaugucccaugaauuccaaauacaauugaggacucuauaaaggacuauaaaaaaaguuguaauaaauuaugcagaccccucagcaguugacucaccucucuggugcuccagguauuucucagcguguucggggucucccuguguuaccuggacagcuccugccaucauuagcacacagccaagauuccucgaccacccaugacucuggauuuaucauccucaagaauugggggcuguggaaaagaugccaaauuuguucuuuucagauuuagguucuucugugauaaaaauagacuugguaaagaagcagauauuucuuuaauacguguauauauuagacugugaauuuauucaucuuccuuauucaucauauaaguaaauuauaugauuggacccaggcauaaaacgugauuugacucccccuugcccaucacaguucuggaguucacauaucauuuguuacuuugaaaaaugaacuuuuguuauuugauuaugguaauaaauaauauacaugguagaaggagaagaaaaugaagaaaaauuuagaaacuuggacagaggaaaaugaaaauguucuauuaauuccacuagcaugagauaaucacucuuaauauuuuguugcauguucuuuucuuucuucugagugauagcauuuuuuucaacaaauugggcucguaauauauaggcacauagauauauaauuaaaaaaacaagaauuucucaugucauuaaacauugcuugaaaaaacauacuaguaauuuccuaagauuacaccauguaaaugaauuguauuuuauguaaccauucccuaguguuggauagcuaggccauuuauaauuuggacacuauuuuaaaaaauaacucaggcuuauuuuacuauuuauuuuugccuuacacuuuuuguaaaaguaaucagagcaguaauaauagaugacuccccaaaauccuuuugccucuaaugauuagucuaagcccauaaugcuguguuccuugccagugauugguuuagaaauagguaugugacccaguucugaccaauggauauggagggugcuuaugaggaagguuuccuacuccuaaaagagauacacaggaagagagaccuucugcuuccucuggacacuggcgcagccuggacuagcaguugccagcuuggguuuggacaaccuccgaccuuaguugaaaaugacccuguguaggacagaggagcaaguggaaagaaccugggugcauuguggcauuuuagagccacugauucagcuguccuaugggccuccuaacccgaaccuccacuggucaugaaauaagcuguuaguuuggugcaaaaggaauugcaguuuuugccauugaaagugauggccaaaaccacaguaacuuuuagcaccaacuuaauauuuugaguuggguuugaaucacguugucuauuacaugcagcaggacacaucucuaaucacgcgagaggucugagcaaacgucuucacauuucacacugcagauauucuuacaaaaggcaaagcagagauccagagaaauuaagaucugcucaaggucguauccagcuuugggaaccccaacuauugcagaaauuucugaagucgucauauugcuacuuaaagcaaaaugccuucuccuaaauccagguagagagaaacucucaaaggccagggucuggacucaagaugagcacaggauuuagaaucagaaagugugaguucaaauugccuucggcucuucaccugggugggcgauuugaauagagcucacagcccugaaaacccugguuuucagauucuuuauugguaaaugaagucagcuuagugauaugagaauuaugaaacauaaaucccuuuguaaaaauauaaaauaaucuuacaaucaucaucgucauccucaucaucguguuccuucacaccagcgguauuuaugguauuuaucaacuaacugcuguguacuaugcucuauugaaaauguuagcaauauaguaaugaacaaaacagauguuaucucuacccuuaugguuuuuauauuuuaauaaaaguggcagaaaagaaauagguaaaacaauaaacugagcucuuuggagaagaggcccacguucuuuucagauucugauuucuccgugauauaaauaguuuuuuaggugaucacuuguuuuuaauguaccuaccuaucuauaccuuucucucucucucucucucucuguguguauguguguguguguauaaaauuacauauccaguaugaaaccuaaaaauaagauuuuggggccugugaauuuuuuuaaccuuucuuaaccuacauccuaauuauuugauuugacauugugaugaaacauacuguuguuuugaauuuuggaaauagaccagugauucuucaguagggucguaaggucccgucaaugcagcagucaaauuuuuucuuggugggggggaugcauauguguaugugugugcaugaguaucuugauaauuuagaaagauuaauuaaacauugaucaucuaugugaccacauuuaaaaugagcaccaccacauccaaaugucugaguuuacauuuugugucgguacuugcuuuggcagaacucugugccuuuccccaagucuucugugaccuucucaccuggccugcauccugguccuuaucaaccguauuuuacaguuaaggaaacucggcucaaacuagcuucggggacucgcuguggccauaggugcccuaggcugcagucugagagugaaacugaggucucacucccuucauagucugcucuccgucucugccucaucuggcuucucagggugguggggcgugggcacuaauuugauuugaucacuuagagacaacagcuuacaaaaugcuaccgagcagugccuguccuuucugagaacuugauauaauaacguuggcuugaucuccucagccugugucuugagggaacaaguaaauuaaacaaguaauuagauccauaauguuuuuagaaguuagaagauuuaaauauaugaaucucaucugagugugcagccuuuugucugcuguguuuccugccaaaagaucucuugacaggaaauaaacauuaaaauaaucuuuaaucccuuguuuggucuauuaccauuaacaauugaugcacuuuaauuuugugggguuuuaacuacaaaauggaacggcuaaguagugauaauuggguuuggaauuauacggucauuuauaucaacagagaugcaaggggcugggagggagggugauuaauuauuuacuauuuccuggcugugguuccuauuauagaauuuucugauauguucuucugugaacaauuaucaccaaaugaaaguaaacaaaucugugauuugaagccuuauuuagaaguuagucuauauuuaggugaugugggcuugauuuucacagacccugugggcugucuguguguguuccuuuucucaguaccccagcucuguauucgagcgugguuaucuuugugcaucuuaaaauccacaaugcacagccuggggagaagccuugguuuugccagggggaaaaaaagagaaacacaacauugagugaggucuagggugaauaccaaaggucuguuuugaaauggggguguggguuauucuucucucuuucugauuugcuucaguacaguaugggauggggaagaaucaaaauuauuaugucaacaugaggaugaaaguuaugcucuguuguuucucauaacauuugugugugugugggugggugggugugugugaaagguaggaucaccucucugugccucagucuccccaucauccuucggugguagaucaaugcuaucugaugaggccuuuuuugggaucacccacuccaacaugcauguccuuucucuguccccuccuggugccuguauuagucuguucucacauugauguaaaggacuaccugaggcuggcuaauguauaaagaaaagagguuuaauuggcucaugguuccgcaggccauacaggaagcccaguuagggaggccuaaggaaacuuaaaaucauggcagaagaugaaagggaagcaggcauguucugcauggcuggaguaggaggcaaggagcgaaggaggagguacuacccacuuuuaaacaaccagaucuggugagaacucacucacugucaugagaacagcaagggggaaaucagcccucugauccaaccaccucccaccgggccccuccuccaacauuggggauugcaguuugaugugaaauuuuggcugggacacaaaucccaaccauaucggcacccacugagcacauccucguggaucuuccuggcucuccuuacaagggguuccuuccaaacccaagcgccacaauccuuaggcagauugcucugacacagaagacuggugaguucuagacuugauguguuucaugggaaacaggaagacauuuaggggaggcuguagauacacagccgcucuguuuagggaaggcugucgauacaccgcugcucugaccaucauggcgucugguccaugcucagauucuggaguguuagggucuucgggcacaugguggaugagcguuuugcuucguguacucauuuauuucugaaaauaaugcagccccuuguagggcuuucuggcuaauugaguggugccaucauucaugcaauugcgcaauucacacaccaggcugccacuuuggccccugcgucaccuucaccaccacccaauguguccugcucaucacugagguuugucauuuuuacucugagucuguccauugucaucaucuccaccaucaccccuuuuguuuucauugccacccuugccuggggugagugaagacgcucuucucuggcuuccacccuuccaaaugcccuuaacccacagaugggaagaaaaugagguggggggaaggggacuuucuugcuuccucauaguucucccccauccuguaaaggagccugugcuucccgacucccagggcccugcagcaugucaagaacaauauuggacaagcuugucagugaggguccaggugguucccugccacuacgaugcaugcuggggucaguaaaaggagaacacagaagaaucagcagacccagagucuaaccccuccucuaguuaaagacgugacccuggccgggacugaagccagaggcccacagccuacuggaccuuuguuucuugcagucagguucugaugacagauuuuaguccccucuugaauuuccuuggaugugauggaagugauucucaguggacaagaggucacauugccuuuucuagcuuggaagguggcgcaaauaacugcuugaggcucccucucuugggccaagcuugacucuggauuuucauuguuguccuuuuuuauuaaaacagguuuuguuuuuuuguguguguguuauuuuguuuuuuguuuuuuuguuuuucgggggcuggaguagugugcagagccuggcggugauuguucucauuagaaaguauaguguaauacucaauaaauuacuuuuguucucaccuugggaaguggacucagaggccaagugacuuugauuuuucacuuuauccuggaguuucucaaccuuggcacuauugacauuuuaggccaggagauucuuuguugggggggauuuccugugaguuacaagacauuaagcaacaucacuggccucuacccacuagaugccaguagcaucuucuauuuccucaagucucaaaauaccaaaaacauuuguagauacugccagauaccccuggggaacaaaaucaccccuggaugagaaccccugcuuuauccucuuacaguuuugguucuuuccaugagaaaguauuuuuaauagcaaaguaaugaacaagaaaguauuaauaagacccaaauaauaauauaaacuacuacuuuacuaauggucauuaugugccaugcccugcucuaaacacuugccauguagucacuaauuuaauccucacaagaauucuguaauguaguguaguuucccagggcuuccuugaaaacgugccauagacuagauagcuugaaacaacagagauuuauucucucacaguuuuggaggccagacaccugacaucgagguguuggcagaguugguuccucccggggcucucagugaaagccugcuccgugccucuccuccagccucugguggcugccauuaauccuugacauucgucggcuuguggcagcagaaccccagucuccgccuccgccuucacauggccaucuucacucucugucuuugcucccuuuuccuauagggacucaagucauuggauuuagggcucacuggaauccaggaugaccucauuuuaccuuaacaaguugcaucugugaagauuccauuucuaaauaagaucacaugcuagggcugggcacgguggcucaugccuguaaucccagaauuuugggaggccgaggcaggcggaucacuugaggucaggaguuugagaccagccuggccaaaauggcaaaaccccuucucuauuaaaaauacaaaaauuagccagguaugguggugcgugccuguaguccuagcuacuugggaggcugaggcagaagaaucccuugaaccugggaggcagagguugcagugagccgagauugugccacugcacuccagccugggcaauagagugagaauccgucucaaaaaaaaacaaacaaacaaacaaaaaaaaaacaaaacacaugcuggugcacacauaaauuuggaagaaaugcucuuuaacccaguaugagcacgugguauucuuauccucauuuuacagaugaggaaauugaggcacagacagauucaauaacuacgugacucacagagauaaccguguagcagaaucaggaauucagcccaguuuuuucaguugcacagccugagcuccuaaccaucgcgccugggguucucaaaggcucguccccaagcgacaacaucagggucaucugggaacuuguuagaugugcucacccucaggcucgccccaccccgccagacuuccugaaccagaaacucugggaguagggcucagcaaucuaguuuuagcccuccaggggauucuguggugccuaaaguuugagaacuucugaucaaaaaugccagauaagaaaaaaaaaccuuucgagacaucauuugaaucaauuaucaaauguuuccaaagugcacuugcuuugcaaagcacuguacuacucaucucugccuccaucggagcgaguucaggagaguuguguuuacuuuucuaaaggagccuuuuccuucccauuuuaccagugcccaaaagucuuagaaaaaugacaauguucauauauuugcccacaugaagauagaaagugucaugucaaagauaaagggagaacagcauuuucuuuuuuuacaagucacucuuacuuaaacacacagcaugacucuccuuacacauuuauuucggaagagcaaaguccggguccccaggcucaacuaucagccgccuucucaucccaagggcugucaccaccagaaauuuaacaugcuguuagugcaugcaaaaaaaagcccaguaauuguagggcucaucaguacauuguuaauugauccucauuuccuauuauuuuaccucaaagcaaacacaucauucaccauagugacaccagaguuguuuaucuucucugugcaagugugugcucuuuuuagcaagcuuuuuggauccucuguuucagagggccuuucccaucuguuuacuauuguggacugugcugcuuuuuuuguuuuuaauuacagguuauauaaaauauugucagcaggagggagguuauuauuaccuuaaagaauaagugguagaugcggacuggccacugugagcccaucacuaaaaugcacuuccguacacuaaaggucccucuucccuggcagacagugguucauuuuauuugaggagguauguugugggcuuggggaaacagaaggaaauuggagacauugauaugcuuccugagagguggaaggggccacuuaacacagcuuucauuuuucaguugccagugggagaggagcuggggugggcauauaaugaguaacauucaaagcuccuucugucuuuuuuucagagaauucacaaaacaacucagggccuccugguccugcaaaaguguuuacuguuuauuuguguuguuucugcuuguuuugcuugccaccagcucccuacucacuugggggaaaauaacccaucaaaggaauagaagcucaggauaaacguuucagaccuuucaguaagauaguaaaauuucuuucauucccagaccucucuccaaaagaggcagccaucauuaaaaguuuguuauggauucuuccagaaacguucuaugcauuuagcaucaguugcagauauggauagccuuuucaaaaaaugcaugcaacugagacuauuggcuauguuuuguuuauuaccuacuuuuuccauuuaauaguaucuuggagauuauuugguaccagcacauguagcucaaccuccuaauacugcaugacggauaauaugccaucacauggugucauuuaauauauucauuccuauuuauagacauugaaguuagauccaugucuuacuauuacacaugacuuaguaaugaauguuccugcauguauauuuggucugcuugagcaaggauauugggagggaggauuuccagcagcagaagugguggaacaaaggcacuguguacaccuuugaaacaauuaacuucaccaaaauuacuaaacuguccucuagaaugguuaaaccaauuuccucucuaccauucacacgugagaaugccuguggccccccagaaauuaucuccagcagcagcaacagagaggacuggaaugccauugacaggucccacaagucagcaaucagcacgccauuuuuuaaaauuuauguugcuauuguaucguaagguucuucugaagcgaccacuucauaacacuguguaguccaaucccuaagcugggcaauuuuuuuuuccccuuucaauacaucacauugauuuucuguaugacuuuaucugcuuaauacaaagugggauugaacaguuauuugucuggauuugaucauuccuuauuaaacauuuaugauuuagcuuucaccgcggcaucuucuuguaagguguuucuuauuuuuaucauuuuccguaaagguaggauuguguugacagcccuguaauaaaugucucuuggaagagauguguugcugagagguggggagggggugggggcucugugcauggaauggggggaaaagcuucagggaagggcagugcaaauuguuucuggacugaugccaucuuuuaauaauaguaguuaauagacuggguacaauggcugacgcccguaaucccagugcuuugagaggccgaggccgguguaucgccugaguccaggaguuagagaccagccugggcaaacagccugaggcaaaaccucaucucuacaaaaaauacaaaaaaucagcugggcguggugauaugcaucuguggucugagcuacucaggaggauaaggugggaggaucauuugagcccgguagauggagguugcaaugaaccgagauugugccacugcacuccagccuggaugauagagcgagaccaugucucaaaauaaugauaauaauuguaguaguaguaguggugguggugguggugguaguaguaguagugaaugcccugacuuugggguuugcaguaagcuaggauuaagugcuucacagugaggcacaguggggagcuacucugaggaugaauugccuaguaaauaagugagguuuguauaaccgaggccagaucuuagaaccuccugcuaucuguacauagaagaauguuuuagucagaggcaaggcaaggucaccaggauucacugagaguguuggucagcauuucaucugcauauacaggacuggaaaauaagagagcgcaaugagacaucuaguuuuuuucucuuucguuuguucuguuucccacugagagaauuuucuagcuuuauguggagaaaacaguauuggaaauuauuacucaguucaagaaaaccucacugagcaccuaccauguaggugcucaucccgauaccacuaucaggcccuuuggaccaguugcaaggaugcaggaugaggaaggcaaugugagaaaacagaaggagcaccaggcagucgugggcuugauuuuuauuuuacuauuuuuuaaaaaacauaaaacaacauacauucaucauuuugcuuucuuuggaugaagaauugagccugguucagcaucucuugcaggcuguaauugaggguggucauugacuggggcuggauucgggaaggauccacuuccaagcugcacaguuguuggcaagauguaguguuuuggugguuccugggcucugggacucagcuuuuuggcuguugguuguuggcuguugccacaugggccucugcaaaaggcagcuuguaacguggcagcugacuuuuguccaagugagaaggugagagugcaagaauuggugagagagaccgcagccaggguguuuuuuuaacuuaaucuuggaagucacauccuaucgcuuugguuuuuugacugagauuauucaguacugcaauagucucccuuuaaaguggacaauucauuggcuuaucguauagucacaaacuugugcagacaucaccacuaucuaauuucagaacauuuuuaucaccccuaaaagaaacccuguacccuucagccagcauucccuauuuuauacccccgaucucuugacaacuacucauugacuuuguuucuaugacuuuaccuauuucggguaauugauauaaauggaaucauacaauacguggccaacugacuucuuucauuuaauguuuucaagguuuguguuauuucauguauuaauauuauguuggugcaaucacuuuugaaccaaucuaacuaauacuucauccccuuguauggccaaauaauauucuauucuaucaauauauuauacuuuguuuauccauucacaguucaugucauucccacuuucuggcuauuaugaauaauacugcgauaugaacaucugguuacuucuggcucuuauggguaacacuucuauaagcguugccacagguugcuucugauuucuauuaugaguaaugcugcuaugaacauucauauacaaguuuuagggcagacuucuauuuucauuccaauaucucuuuauggcaugucuuagcagugaugucuaugacauccaggaugugucuugacaugucugacaucauuuaaauaaaaauaaaguagggaaagaaaacagauagugauugugugugugaucagugauggcuuuugaggaggugacauuugaacuacacccugaaugaagagagccaugcaaagaccucagcaaagaaaaucucaagcacaggugcagcaagugcaaaggcccugggguggaaacacacucgauguguucaagggagaguaaguggugaauggguuuggagccaacagggauaauagacaacgcuaucaagaggggggccaaccacacaugugcagccacuguaugacgucuggauuuuccuugacuuauggugaucacuauugggaggugguaagcaaacaggugacauaauuugaaucaugguuuuaaaagacgccaugguugccaugaggaggacaaugcguaggaggcaggagugaaagcuaaaggauaugcugggaggugacccuggaguuaaagagagcaacuaaggugaccaggugacaauaauggagauagagaaaacaggauggauucaggaaacaugaccacacugagcauauucaaauguaauugucaguuuucgugucucccucccacuggaccacaagccccuaacucuucauguacacacccugacucccagugugggcuggccacccaggaggcacccaguuuaugugugcugcgugagugauguggaaugacugcccacguaggaaguggcagguuggagaaaaagcagucacagcuccuggcugcuguggcugcuuugagcuucuuccucgaucaggcuggaucauuaccagccuguacccucaaaggaugcccuuaguccuguccccucucacuagcagggauuccaagcuuguaaauaaagucucccacuuaaaaugugagcagagugaagagcuggcagugucaaaacucuguguccagauguuuuaugauuuucccuuuuccagaugagcccgguguauccguaucagugugucuaggaagaccaagcaugccgaacggccagcagaguagaaacucugugugcccauccauuauguacucccugaauuaggcuccuugaggcucaauuauuaaagugggauuuuucuuaauuauuaacaguuaaaaauaggaaaauagauuucaaggggaaaaaauuugcaggcaacaagaguccaauucuaaaugugugcaugugcguaaaacggaauuugccaaacaugaauaggcacuuacaaugugacuggaauuggcucugucaugugucagccuaauagccuaaacccugguucaauacaaugaacuugggaagguuugcuuaaugaaagaacugacguuuucugugcagcggcugcauucaucagccugcauccuguucauuacacuacaaagggcugccaaugggaauugguaggaucaucuauuagguaaaugcgauggggacaaaagauagcagagcccggggcuuuguggaauuuucuguggugguccggguuccuggaguagggagcugugaugacgggcaacagauuuccaaguuggcacgcgggcuucuggagucacgggcugaauuccggcacugccacaucuugccacgcacauccuaagggaguguagagaagagaguuuucaguuaugcaugacacugccuuacccauuguggauucaguagggauauucauaacugugaauuugaauauaacuauuaaauaauugaauuauuauuauugaguuacugaauauaacuauugaguuuucccucuccaucugggcacaugggaaggccguacuuuccugacaugugauuugcuguggcgaguggaaucugggggcaagagacgugugucuccuugaggcagaaacuuuaacagauuccagccugcugcaucauaaucuccuuucccucuaccacgcugacuggcaguauuccagauuccgauugcccugucaggguggguccuagugguaggacaaaagcaagaauccugagcugacccaagacacacauggaaacauuaauugugcuucucugauguggcuuuaagauacuugcucugucgcccaggcuguaguguagugauuccaucucagcucacugcaaccuccaccuccuggguucgagugauucuccuaccucagacucucaaguagcugggauuacaggcaugcaccaccaugcccggcuaauuuuuguauuuuuaguagagauggaguuucaccauguuggccaggcuggucuugaacuccugacuucaagugaucugcccaccuuggccucccaaagcucugggauuacagacgugagccgcugcgccuggccaagauacugagaugugggggccaggcacaguggcucaugccuguaaucccaacacucugggaggcuaaggcuggaggauugcuugaagccaggaguuugagaauagccugguuaacauagugagagccccauguuucuaaaaauuuaaaaaaauuagccgagugugguggugugccacaguagucccagcuacucaggaggcuaaggcagggggauuguuggagcccgggaggucaaggcuguauaguaaacugugauccugccacugcacucuagccugggugacagagcaagacacugucucuuuaaaaauaaauaaauaaauuaaaaagacacugagauuuggggguuacuuguaacugugucauaaccuggcuccuuacugccaucggcaugccuagagggaucccaguuuuacacaucagaacaacccaagccccagugugucacgccauuacaugcuuacagccuauuuuuacaaaguuugaauauuguaauuugccuuuaaaaaauuguuuuaaagaucugccuaggucagcaaauuuuauuuacucucuagaaccauuugauugggguacugccuuaagaaauaaagcagauuccuucagucgcaugugggccuggagucacuggaaaaugcagacaaaacaagaucugcugauuggcaaggucaucuugggaagggccaucgugcaguaaagagcagguccauuaauucaggggggauuuacaucaguuccaucugccucuuuccuaaugggacuguuugguuguguucuuuccuggagagauuagugauugaaaggaggagaucuagaaagaagagauaaaaguuuacauuuaauuuucaugccaugcagcguucuacgaaggcuuccuaaggaggcuccauacuaaauucagacauaagucagaaggcagcuucucccaagacacuguugauguccagggggugacaguuccaucacaaaaggggguuaaaaggguuuaggggaaguuuaguugucuuccuuuuaucucuaacucuaaaacccaacugcuggcugaauuaaaagucucuuacauaauggucagaggaguuuugaguaucggaucuuuguguacuugcuuuuuaaauucagucacgucuuaaauaguacuuuucacucuccuccucuccacaccacuuuauguguuugcuaguagcuuccaugaaacucuaugggugaacaugucugcaacucuuuggcauuuaaauuuuagguuucugccccucguagcagacuaucuuucuagaagcagagcuguaagucucuuuuaacaccauuuucaagcuuggacaggcugacauuuuuauugaauggguuaucucaauauauaucuacuuuuuugcauccuacuuuuuuuagaaaauuaaaaaugauaugaugggugugguggcucacgccuguauucccaacacuuugggaggccgaggcggguggaucacaaggucaggaguucaagaccauccugguuaacacggugaaacccugucucuacuaaaaaguacaaaaaauuagccaggcgugguggcaggcaccuguagucccagcuacucgggagacugaggcaggagaauggcaugaaccugggaggcagagguagcagugagccaagaucgugccacugcaucccagccugggcgacagagugagacuccgucucaaaaaaaaaaaaaaaaaaaaaaagauaaugaugaaaauaauagaauauugaugagaacacccauuacucugcucauuguucaaaugaacucauuugagagcucucuccuuuguuucugucuuucucucgcaucagcuugcaucuguuugccuaugcuauaaggcaucagugguuaccaggcaguguugcauuuuuuccaucccauaccucuguguguguuccuuaucuguuucuaggaugugcccucugccccgucacaucacacucugugcugcucucagccaaagcucuucuuaaauacacuagccaucaaaaccauacaacuuggcugggugcgguggcucacaccuguaaucuuagcauuuugagaggccgaggcggguggaucacuugaggucaggaauucaagaccagccuggccaccauggugaagccccgucucuacuaaaaauacaaaaaauuagccagcugugguggcacaugccuguaaucccagcuacucgggaggcugggacagaagaaccacuggaaccugggaagcggagguugcagucagccgagaucuaugccauugcacuccagccugugugacagagcaagacuuugucucaaacaaacaaacaaaaaacauacaacuuaacucucauacccccacgccugucuuuucuccuguucgacuugacuccucuugggaauuccguaaguacuuugagggcaaggaccacaagauaaaugucguaagguaaccaggaaugacauuccaagauuccauucuuuccuuuguauauccacucaucauucauuauauucuuacucugggcuaggcccugggaacaguugaguaagaacaagcaggaacaaacaauuagaacauuuaguguggcaaggggcgugacaaaguuaccaagagagguaggugagagacaggaguuguuaucugcggggaacaggugaaggagugacagcagggggugaggauaagaaggaggaagcuuuaccccugagaagagcaggcaucagaugggcuuuggaaucuacauggguguuuguagguagaccacccuggaaguugagugauggggaauaaaaggaagaaagugcauucugaacagagggaauagcagguacagcagcucagacaugggcaccuucagagcgugucugagucuuccugaugagacacgugguguucacuugauaacucccuggcagguucucuucaucgggccuccacauaggguaugcgaaccucuucauguuuuuaaaagggagagauuuaauaaaggcaauuugguacuuaaaaauuguuagaagagcuaaaagaguaguuuugagguugaccuucagaacggcuuccugaauaauacagaagugacccuccaggaaggcccuuccacugaagcuacaacuggagcuaagcagauggauaagccaaaaccaccuccguugcuguggccccaucuccaccacaaggaagcuggagaagggaccccagaaccggaagacaaaaaacuuccuucacacacucccuugcuaagaggagaagccccaaagaagcuggauauggcccuucccucacauuugcugucccaagugucccauggcagugccuaagcaauuggugggauggauuugugucuauaaacaaaguugcaagggagucuggaaagggaguuuuaacuccaacuucuucaacuagaaugguaggauccaggggcagcauugcuccccaggggauguuuuuacaaugucugggauauuuuuuaguugucagaacuggaagcaggaagaagugcuacugucaucuaaugggucaaggccagugauggugcugacuauccuacaauccauaggacaguaccuaccacaaagaguuaccuacccccaaaaugucaacgugcccagguugagaaacgugaccuagcuggaaggugaacaggaacuaaaugagucaguuucagauauccaacacaaauacgucacuuguuucuguuccaaaaguauuauaauuuuuguuugagcuaaaaacuaguuacaguucauuggauaauugccuuucaucccuucaauauguguucccuugaaauuugcauccaugcaucccacauggcaccccuauugauuauuucagugacucagaagacuucauuauucaaaauaaucucuaauaagauguuuagggagaaggaaaaauaaaguuucucuccacguuacguuuuuuucuugcacauguacugcuuuuucauaagcacaaucuuauuaauagaacaaguccucucaaaaugguugccuuuucucccuucauccucccccaccaguaauguagagcuguuauuuggcucguuuuucuuuuuccuccagaggcaggaagagggaaugaaugguggccaagaauuuuaaauuccuguucccggccgcccccggaagcuccaucuuuguugugagggcuucucugcgucaguagaggccagcugagcucuuauucaccccuuauucucugguucccuuucaccagcagguccagcucuaaccacagcuggaguuuaggaaggccaggcagcguguguugaaugccagccacucuucuacccagggucauauccuuggauguuuuucugugcaucugucuuuuccgacccucccgugauucuggaaggaaacaccuuuccaagcuccccagugacccugguucaucccggaaauaugcaggaaaagcauuaugagcauugcagugccacaugcugcauugguguguuacguuaugagaacuauuagggcugaucucugagaaacuuaccaguggugugugaucggaaaucaugucacccucugaauguggguuaugggauaaauggcuagguacacaggcuucagaguccagccagccccagguuuggauuacagaugguugcuguacuagaugaauaauguccccccaaauucgugucuaucuggaaccucagaaugugaccucauuuggaaauaaggccuuuuuaauuaaaaaaaaauuuuuauuuaaaaaacagagauagagucuugccaucuugcccaggcuagucucaaacuguugggcugaagcaguucuccugcuuugaccuccuaaagugcugggauuacagacaugagccacuccaccuacccagaaauaaggucuuuauagauguaacugaaauaaagauagagaugugaaugugaucguacugguuuagggugggcccuacauccaauaagaauguccuuagcagagacagaacagagacaccgagagaggaaggugaugccaagacagaaguaaagauuggaguggugccaucuaccagccaaggaaugccaaggcuguggcuacaccagaagcuggaacagagccugcaagcauuucuccugcagaacccccagaagggacucagccugcagacacucagauuucaaaccucuggcuuccugaacugugaaagaauaaauugcuguugggccagguacaguggcucaugccuguaaucccagcacuuugggaggcugaggcagguggaucacuucaacccaggaguucgagaccagccugggcaacaaggcgagaccccgucucuacaaaaaauaccaaaaaaugagccgggugugguggggcaugccuguagucccagcuacuugggaggcugggauggaagcaucauuugagccugggagguggagguugccgucagcugagauugugccacugcacuccggccugggugauagcaugagacugugucucaaaaauuaaaaaauaaaacauaaauaaauuucuauuguuuuaagacaauuugccuguggcccuaggaaaccaguauagauaacuugugaugguuuagcuuauuuaguacaacaacccugccccuucuaguuuuuaugauaaccucauuaauugccgguacucucagagcccugauuuucuuaccuauaaaguagagauucccuaucucauuuggaggugauuuuaaggcacaaaugagacaguguauguaaagcauuuggcauagugccugauucagaguaagugaccaauaaauagcuacccuuacuauuuagaaugcuauuauuuagaacauaaguauauuuaagaaagcaccaucaguauucaauuugccuugcuaauaaaaagggaucaagauauggauuguaaaguagaaaaauacaugucaauuaaauggauuuacaucuuaaaaaguggugagguagacacacaggcacuacucacuucauuccuucucaucucaacccguuaggauuuggccuucaacuggguaguggaaaaaauaugauccuuggcagucuacuacgcaaaagcaggaacaucaucugcuuuuggguaguuaagaguuaaguaucacuuugagcuacaggaucaugauuaaaaagcauucuguuaucuuacuucacaacucuccacuuuuguaaaaguuuaggauaccggcagggcagcaaauaccuuuaaaugauuuuauuuaaaugucagauuuaauuaaauccaugaccagaagacaaacccaaaggaaauuuucagggagcuuuagaauuuuccuuuuccauguucaaggugauaaccguagcauaaaacugucccaaccacaugcaaaugcaagcaggggcauucaucaugaaaauacagcucucaaggcggaagugcuuguuaacuuugcacucuauagccaagugcgaugaucagaaaauacauacauugaagacaccagaaaauaguguauggauuggugauuuugacuaagacuggaaugugggugugugcacuccucauguuccgguuucugugaucauucaggcaugcacagguauccugauggguagccaggucauuaggcccagagucggcaguguagcauggcaagagaagucauugcaucuccaaacugugccuaaauugccuguaauggguucuuugcaacuugcagaaccagaucuuaccauuugcaaggagaauagcugaaaagauacuuaaauaaaagugaucggaugaaauuuuaaaaacgggaaugaccaaaaagauucccagaggaccguuacuggucugcagccccccauuuuagggucuggcauuuguacugauuauggccugacagcucuugaguuuccaaugauaacagccaucugacuugaucggaguucuauggauuuucacuaaaauagaaucaucgccuuggugauggauagaaaaaguaaagcaauacauccugauaaaugcugugccuuccuccuucgucucucuggcggugaccuugugcaauccauaagagggcaaggcugagagccccggccaccgccgccgugugucagaacuuggaaauuuaaguagcuuugaaacccgucaauggggugaagggggaauggccugagaaagcaauggaucaugcuuagagggcucagagggaaauaggguacgcugaaggucaacgugcagacauguccugaaggaacagcucaaguccucauucucauucacgggaggcugcggcccugugaggugagaucaguagaagaguacaauaaaacaggaauuuucagagcauguaauuucuucuuggaagugaaaggcacuggagaauggugcagaauaagcacuagccuuagagagaggaugcccugccccagucucuuucucugaguagcagagagcuggcugugcuaggaaacucuucgccucucuaacaccacguuuauucuccagcccaguuaucuuagccaacugugaacauuuugaacacuguugaucaucgguaaugacaccagcaccauaacacgaaaccccucuaaaacagggcuuccaggaaacucacagacuaguuacauccccaagccuugcauacuugauuggaaagagaagcuucuggaugguugaaggggaaaggaguuagacguuggcaggcacccauuaguguugguuacgacuugcuaaaagaaaauauuaagauaaaaauuagaucauaaauuuggagccaccauuacgaagccuaaagugcaaauugccaaacaagucaagagacucauuagcauuuuauguaaaucaguuauuacuguucuccacuuccuuaauuauccauguuauuucaauacaacccuuucuuugaugucccaauucuauauuuaaauagugcaagauuucuaucguauccucccgcagagguuugugccaugcaaaaaacaugccaagagcagcuauuuuagagacuacagggaaauguuuaauugguucaucccauuugaguuaugaggguguauuacugagcacauaaaaucagaaacauggaaaguacuagcuuggagaaguuuacuaaaaccugcaagagaccgcuugaaauuuugcccccaagacuuuuuggauucucgaugggaaccgacucaaagagaaauuucgcaaacuucauggaauuuugcuaagugauugauuuauaauugaaauauuuggaaauaaaauccaacagcucucuuuccuuuggcucagagacuuauuguuuugguuggaugaagagaacacuugugacagagggaggaacauagggugcauaagagagauguggggaagcacuccccauccaacucguuccaaccaguucaucuuuuuuuuuuuuuuuucuuuuuucgagaaagaguuuugcucuuuuccccaggcuggagugcaguggugcgaucuuggcucacugcaaccucucccuuccaaguucaagcaauuguccugccucagccuccugaguagcuggaacuacaggcguccgccaccaugcccagcuaauuuuuguauuuuuaguagagaugggguuucaccauguuagccaggcuggucucaaacuccugacgucaggugauccacccuccucagccucccaaagugcugagauuacaggcuugagccacagcacccagccagaacuucauaguuuacucuuauuauuuucuccuaaccacuagguuccacacuucuggccaccugccuuuaucuccugccccauaaccuaaccuguuuuaaaauacuuauuaaacaaagaaaaauaaacaagaacaaauggagaaucuuucacuaugacugcaacugaaaagaggaguaauggaaggacauguacucuucccauauauuuuuaaacaauuacuguaucugauuuuucauuuuucauuuuuuuuuuuucuggaagaaagagcagaucuggauaaagucaguauacaauguggucuuuggugacagacccaaguucaagaccaagguguaugcauggguuuguucaaguugucuacccuuauuauccccucagugaaacaugauuaaccaugcuuaccuugaagaguuaucuuaaauauuuguguuaauauuauauauguacauuacaugguaagugcuaaguaaaugguacaugugagucuuugcucuaggcaaggcgcugugcugaauguuuacauagaugaucggauccucauauuggauccucaaaacguucaucaaaauggguaggauuauuuuuauguauauuuaacagguaaggaaaaugggguuucuggaggugagugacucacucaagaucacguggaaucaagcagagaagcugggguuuuaauucagaaguucuuuaagcuacagcuguaauugagacaagaaccguacacuguaguaagauuaauguaaagauuuaaaaaacuguucauaucguucaucuacauaaauaaauaauauuuacagaaacucaucucugcagacuaaaguacuuuaaauauuuaaucuaauuuauugguuauuuauuuaacaaauacuuuuaugggccuugccauguuccaggcacgguuguaagcacuuacaacuagugacucauuuaaccauuucacaaauauuuauuuugagagcaagcacggggguuuaugugauggcuccacagagcagugaaaagacucccgcccuacugcucgcaaccucagaugucccugggcacuagcccaucuguaugucuuuaaaaaaaauaaauuaaauuuuuaaaaacaugacuuucuggccaggcgcaguggcucaugccuauaacccugcacuuagagagggcaagacagaaggauugcuugaggccaggaguuugagaccagccugggcaacauagcgagaccuugucuguacuaaaaaauuauuaaaagaaaauauauauauuuuuuuaaaucaugacuuuucugaucauaccuguggcauacucauuauagaaaauuuggaaaauguaagaagucauaaagaagugggaaaaaauuuaaauccuucucugucccaccacaaaccauuuaaaucaauccaagauuuuaguggaaagggaaagcauaugaucuaguacaaagaauuuuuuuuagcuucuucuccgcugcuuguuuaagaaucucagaguaauccagacguuacuacuccauaagcaaaucugggacaguaaucagacaaccagacaaccagacugagagcccccaaggguucaaauuccugagcgccgugucuucucuauagcuugcugucuuguucuauuuggauauaaagcuaccaucaagcagaagaagcgggaugcucucuacagaguccgaaacaaaacacagaaaauuaaccugcuaccauccucuaaagaagcgagggucucagacuuuguccccuuuuguuccugcauugcccuccauucagaucuugucacuuaggccuugguagcaugagcuauuaacagcccuccauauuuacuauuuuuuuuuuuuuuuuuaacucugggaguuccuguugcagaaauuggaucacuuaccuaaaaagcuccccacccccaccuuuggugacugguggguuucaucaccaggaaagcacauuguuccaacucaaagucuacagucuaaaaucaucaucauguauuuucaucaggaugaaauaucgggcacucugcucagugcaagguuuuauuaaugaugugcugucaggggcuggauguucugcauauuugcauauuaaacagcugagugaagaaacauugcuuuuauugcugcagggaauaaaucaguuuaaagcaaguucucaucauuuauacucguuucagcuaagucuucuuuuauugaaauaaauuguugaagugcuuugcucauucuuugaauacugaugaacuuuaccuugauaggaccucaggaaaaauaauauuuucuuaaaggugcaguauuguuccauuuuugaguauuacuuuaauacauuauugauaaguuaauuuagaaguaucaagugaaaggggaagaaaaacaguuuugaauaaaaacgguguuuccucuggacuauuuugccaaaugcauuuuuauugguagaacguaagcaaauuuaaaaaagcaacaaaagcaguuuuuaugaauaccuagcguacuuuuuuuuuuuaaugaaccaugagcuguuuuugcauucaaauucucguaggcauuauauugcaucuacacauaaggacacaguguuuacagaccccaaagcuugcuguccccugggcaggugcaugagggggucccaggcaaucaggcucuucucaaaccugaauuauacccggccucaggguauaggggucaggcagcuguuugacaggauucuugcaaauguuuuugguuucucugucuacucauuacguacacucugccagagguugaaaacucaauguugagauuacauacauccugaaaacacuguuuaaauaaaauuuuggccugcauccuguuuuugaaaacuugcaauggcuugccaacguuuucaaguugagaaguuucacaaaaaaaauucggauuuccagcuucuuucaaaaacacaggucaaacauccugagccuguucuguggucaguuacucauuagcagccucugcucuaggaggaauaguuauggguccuuucagacaugcaacccccaaaacuccauguuguuuacagugugggacaccugacuuucaccuuuuaugauaccugccuggggcaugcauguggugacuuuuuccaucucuggucucuaucuuaucucuugugaugaacucaggucuauaaagcauuugggcacugccuggcacauaggauauguccagaaaacacuagcugguauuaaaacagaggaaacaugggaacugaggguggucagugacaucacauuguauuuccuuuaugguguccuucugaguacagaaccaaacauuucuuaggcguacaauuuccugccuccaaauuaauguuauuucuaaaaaguagcccguuccacuccuacaaaucuuugcccaaauauguccuuuucagggaugacauccuuagccacuguuuaaaauagcaaauuucuuuccaaacucugccgucccugaaucucuacccugcuuuauuuuucuccuuagcagacaucauuucucuguuuaaucugucuacuugcuaauugucucacugcccucccccuccccacuggagagugaaugaaggcuuaagguuuugucugccuuggucucuccuggguccugaguaccaguggccuuacguggcauuugguagauuacaugcuuaaugaaaagugagugaaugggcuggguguggugggucacaccuguaauccuggcuacucaggaggcugagacaggaggaucgcuugagcccaggaggucaaggcugcaguaggguaugagcgggccacugcacuucagccugggcaacagagcgagaccuucugucuaaaaauauuuaucuauauugagugaauaaaugaaugaauggauuauuuuaguuuggccucaaucuuuauagaaacucaauucaacaaacauuugagcaccuguuuguucagggccacgugcugguugcaaccuggaaggaaaagcugggcaaggcggagauccagugcucaggaagcugaguccaugccaagaugugauaauuguauaaagaacuacaauaggcauagguacagaucuguaaaauaugaaaacaggaaaacacauggagucuuggaggguagggaagucuugaugaguaagauugggucugagauaaaccuaaaagagggucaagauuuugacggagggcuggaagggaggaacgauaggaaacugaccuuuuuucagaucucuucuugugcguggccugggguuaagugcuuuacaugcauccccucauugacuucucagagcagcuccauaaagagucccugugcuucccaguuuacucuggagacgacugaggcucacagagguuaagccaccuacccaggcuggcaccgcacacuuuguucagagugggccuggcauacggcaucaguucagccuggcccuagacccuuuuccucccacaaccauauugcccccaguggagagacaggaaagcagggaagggggcaauugccaagccuguuucuagaaucucaaggaugccauuuggugaagcugaggcuggugcaguuacucuguggagacaccagcgucuuggaccuagggauggauucagggaggauugugucccccagugaccugcuuugugaaagguagagaauagauuacaggugcccgagauccuagaacccguuucuuaccaugauggcguugagguagagguagaaagaugggugagguggcugggugcaguggguugcgccuguaaucccagcacuuugggaggccaaggcggguggaucaccugaggucaggaguucgagaccagcuuggccaucacaguaaaacccugucucugcuaaaaauacaaaaauuagccaggcaugguggugugggccuguaaucccagcuacuugugaggcugaggcaggagagucacuugaucccggggggcagagguugcagugagccaaaauugcaccacugcacuccagccugggugacagagugagacuccaucucaaaacauaaguaaauaaauaaaaaauaaauauaauacagacacaggcuuuucuccccaccucuuuuaauucuugaaaggaacaguaacaagcuccuauuccuguuuccuugccaggagaaguauuguuuucauauaaaucauuugugacagaagcuccuuauuuuuaaguggaaaaugcacauuuaauaacaugagaauaauguccaaacaucuucucauugauggcugccaagagaacagcagcacucuugcugccugcagaaagagacacucagagucaacuguuuuaggggccaugcugucauugcugccgcauuugcuuaggugggcucugagcagcagcuucccagacacuccguaaccaauggcagcugagugcuuuugugccuugcaaauccucuagucagagcagaccuggcuuaggaccccagcccuaccacuaacugacuccaugcgcuccuaucgguucuuuauuuuaccucugcaagccucaguuuucucaucuguaaaguagggauaacauuagcuucagcccucacaggcuuagagugaaguuuaaauaagaaaagguaucuaggcugggcguggcggcucacgccuguaaucccagcacugagggaggcugaggcugguggauagcuugagcccaggaguucgagaccagccugagcagcauaacgagacccgucucugcagaaaauacaaaaauuagccaggugugguggcaugcaucugcaguccuggcuacucagaaggcugaggugggaggauugcgugagcccaggaguucaagaccagccugaacgacguaaaaagaccuaucucuacaaaaauuagcugggcauggugucacgugccuguaguccuagcuacucgggaggcugaggugggaggaucgcuugagccccgggagguagaggcaugaucaugccacuucacugcggccugagcuacagggacucugucucaaaggaaagaaaacaaacaaacaaaaagccauguagagcugggcuauccaauacuugaagguagccaguggacacguggggccauuucaagcuaaauuaaauuuuaaauaaaauuaaagauucaaucucucacucacacauuacaagugcuaaacauccggacacaucuaguggcucccacuguggguagcacauacagaaagaacguuuccgugacaguagagugucccauugcacaguuuggguauggagcacuuagcccaguguugggcacaguaccugcugugaugguuaaagcuuaguuuuauuggccaggcaugguggcucaugccuguaauccuagcacuuugggaggaugaagugggaggaaaguuugagccuaggaguuugagaccagccuggguaacauagugagacccucugucuacaaaaaacuaaaaaaauuuaggccauacuuaguggcucacgccuguaaucccagcacuuugggaggccgaggugggcgcauugccugaggucgagaguucgagaccacccuggcuaacauggugaaaccccaucuguaauaaaaaugcaaaagauaguugagcgugguggcgcaugccuguagucccagcuacuuuggaggcugaggcaggagaaucacuugaacccgagaggcggagauugcauugagccgagaucaugccacagccugggcaacagagcaagacugucucauaaauaaauaaauaaauaagcuggacgugguggcaugugccuauggucccagcuacuugggaggcugaggugggaggauggcuugagcccagagguagaggcugcagugagcuaugaucuugccacuauacaucagucugggugacagagcgagacucugucucaaaaaaccaaaacaaaggucaauuuuuuuuccacauucaucuauaaaacaauaaaggaaacauccuagacacuugaaucagagcccuuuuaauuaugacuucaaaaaacagggcucgugccacccaagauuuccuccauauacaaaaaaaaaaaaaggaaaaagggaagaagcaaaggggcaauacagggcucugcccauuagaaucucuagggacagaccgagguuugagaguuccugcuccugaucucaggggaauccugaauuacagguguuaaccugauuauccccagcccagcucuucguuaauuaccugaagugaaugggacaguuuccaauacucagcacaaaggcgugcgcagugacucuguggcguacuaucuauuuggccuuggaaaguuacucucuaagucagggcuucuuuucuucaacuuuggugugagacuccgcuggagagcugguuagaaaaacacaagucucgggccccaccccgcagagccccucauucucuaguucuggguuggggcccaggagucugcuuuucuagcaagcgcccagaugucacugaugcuuacagcucucagaccacaguuggagcagugauuuuuaaaagucuuuucauuuguaaagaguuguucuccaugcuccaaaugacugugacgacugagaaaaugcauguauguaaagucugcagcuggugacauuguagacacucagcaaauggccuuugguguuacuguuauuuuauuuuuacuaauuauuuuuuacaccuacaaaucaggaucugcuacaaucgcuugauauuugaaaauugggccuaacccacuaugccacucuucugucaugaaauaacaaucuucuauuuaaacuaguaaacuuaauaguuuaaaauacuugguaguuuaauaguuuaaguagagccacugaaagauggcucacaccuuucagcucaguuuuuuuguaccagugaggaugaauguuucugcauguggguaguuggcaccagucuucaaugaauuauuuuuccuuuagccgggucuggugguggcguguaccuguaaucccagcuacacagaaggcugaggcaggaggauaccacgagcccaggaguuggaggcugcaacgacuuacgaucaugccauggcacuccagccugggugauagagcgagacccugucucugaagauacaagaaggccacauguggugguucaccccuguaaucccagcagucugugagacugaggcagaaggauugcuugagaaguuugagauuggccugggaaauauagcaagaucccaacccuauuaaaaaauuaaaaaugaaaauaaaauuuuaaagaaagguauuucuccccuucacgguaauuuggagccaguacuucuugcaccauucauuuguccacagcaugggacaaaggauaaugccuuaaugccugcugcaaauagaacaguggugcuuagcagcuuuagauaaugcauuguagguguuuugcaaaaacauacuuucgugacuaaacaucauaagcuccaagugagugauuuccccgcguaaaugaaugauucugugaggauaacacuucuaagaugugagauuucaauaaaugaaucuguaggcugcugugauggauaccuuuggugggguaggaaggaucgucauuuagaaccuggguucugacuccagaugacuuguuuuguucuaucccagaaauauuccuaaaaucgauuuccaguuuccaaaagagcagguaaggaaaacacugaguguuacuuggucuuuaaaauuuuuuuuaaauucauuuuuauuuuuaaaaaauagagacaaggaggugggcgcgguggcucacacuuguaaucuuagcacuuugggaggcugagguggguggauugccugagcucaggagggcggguggauugccugagcucaggaguuggagaccagccugggcaacaaggcgaaaccccaucucuacuaaaaacauuaaaaaaaaauuuaggcgugguggugugugccuguaaucccagcuacucuggaggcugaggcacuaguaucacuugaaccggggagguggagguugcagugagccgagguugugccacugcacuccagccuggcugacagagggagacucuaucucaaaaaaaaauaauaaaaauaauaaaaaaaaaauuacaugaaaaauagagacaaagucucgcuuuguugccuaggcuggucuugaacuccuggguucacgugauccuccugccucggcuucccaaagugcugggauuacaggcacgagcugccacgccucaccucuuguuuucaauaccauugauaaguuguggucuucagggacuugugggcauuuucaaguuaaauauccaacagucgugauuuagggcaugaagagcucacucaucaagauguauguaauucagauuuucugaguguuuaauucggcgucuuuggucacaaggaacagaguuuuacuugugccaccucuucuaagaaaaagguuuacuguaagagauaauguuggcaagcugaggaaaggaggcaguuuuggguaacugucucuugcgauccccuccugcacaacuguggcguucucuuuuucugacuagcugauucugcugcugcuggauuuauucauucuucucccucacaguuuuggcucgcacaugcuuccuuuuuagcucauggccgugcaguucaacucaaccucauggcaucuuuuuaucagcugucccugcugcaacaggcuuagaguugguuucccaauucccuagcgcagaaauccacuggcaugagucaucuuucccauugguagauugcagagcaaacuucuggacagauuugcccuuggcucauguaugauuggaccugcggucuguccagguguacucagaguggggaaggggagcgguggcagguaauacaaaacccaccuaaguagaaggaccuaugaaccaugaggguuuuccuuagcagggagugccaguggguagggaugacugguuuugcaguuuagggccaagugaguuggaaugacagcuguggcguguugagucagaucaaguccagaauuccucuccaccccacccauuugcaguucccucagauuuauuacgggaccuggaugugaugcaagcaugcccgcuggcucaggcugugccucacagcugcaacaucccugggguggagaagccaugugggaccucacagaacacuccaccgucccugcuaauggcugagaaaggacucugcccucauggaugggguugggggaccuguuaucuucuuccagguuaaucuugguuucagcugcuuuaaacucuacuuuuuagugggacgcaucauacugaacuauggaagcaccauaguugucaccuaguugagcuucucuuuguucccauauguuucagugaagcaguuauagcuucagaaaagagggagccaggaaauacacuuguaauucaucacuccuuuuauagucagagcauaggaacacucauaguauguaucagaaacuagugaacacauguuguuuuacagcucugucugcaaaauugcaucgugggccucuuuggggaguguucucaaugugauuuuuauucugggguguccuuuggccacaauccucaggauuauuuuuucucugugcuguucacuguaacaucguccacccucugagaucuugcuuuucagucuacugguaucuccacuucucucugcagcgugaugucuagucagaguuuccauucuguuuuuaugacccugggaggacugggagagaucugugaggucaucuuguccacccucagccagggcaggaguauucccuaaugguagagucaaguguuugguuuggucuuguuucuaaugacucaagugaugaggccuggggacgucccuugggaagcuauucugcagccuaauaacuuucauucugugauuuuuuuuuguaugugucuaauauucagagucugacacaauaaggccauaaagagcuaagucugucuaugguagaucuucaccugggaauguucuccuaauagucacuuuuguuauaaaucuucaccuagcaugggaguuaagugcauuuuaaaacuagaccuggggacuauguauccuaaaaugcaaaaauagcccccaaaaugaaaauuaauguugagaaucuagucaaucugccagcaguacguacauaacuguucuguguauauuucacauggccauauauguuuugcuuguguggugcuaaaugcaaaggcagagaagcuucugcuauugaaugcuuagcacagaacuccuguccucccucuuugaaauuauuccgacaguugccccucauuuggcuugccaaggaguaagaucuuggcuuguguguuucucccaugugugguguaucuguaaucucggucacuguugagagccuggugggaggcugauuauuguugagggaaagaucugagagcagggccaagaaagggaaagagagagagaggaaaaaaaacaaaaaagaaaaagaaaaaagagagguggguagggagggaggagagacauggacccacggggaaugggaagagaaauagaaauagggaauuugaaauggaaauaaaacaaaagggcaggaaaggaagaaauaaagagaaugagauaaaaggaaaagaaagugcaaguagauuugggaucuauagauuggggaaagacauucauacagucaggaccagauguucacuggaaguuuuuuccuucuggauccuucuuuggcuauaggaaucugguucucaaaguguggcucccaggccagcaacaccagcaucacucagaaaucuguuagaaggccaggcgcgguggcucaggccuguaaucccaggacuuugggaggccgaggcgggcggaucacgaggucaggagauccagaccauccuggcuaagucggugaaaccccgccucuacuaaaaauacaaaaaauuagccaggcgugguggcgggcgccuguagucccagcuagucgggaggccgaggcaggagaauggugucaacccgggagguggaguuugcaguuagcagagauggugccacuguacuccagccugggggacagagcgagacucccugucaaaaaaaaaaaagaaaucuguuagaaaugcauauuuucuguuuucaccccagaaauccugaauaagaaacacuaaaggggagugggcccagcuauuuguguuuuuggaggaacuccuguuuuaauuuguuuuuucggaaguccuccaguuugagaaccaaugauaaggacauuuuuccgggaauccaguuguuuuaggaaaggcccaguaggcauuuauguuuauaagcaacuccacccugcacuccauaugccuucuguagcuaucuaacagagacagaguugacuugcagaaacuguuuucucuggccaggagacaggcuucguuuucgaaacucacccaggaaggcaguguucuucuuuucaaaaggcauuuuucuguugacugugcaugaagccacauaguaauaaacaguuuccauauccaagcagcuaaggcuugugccuugcaaguuaaguggaacaucacgaucuauaucucaguuuuccuuauguuuccccaguuggcacaucauggccaacaagagaguagggaucauuaaggaguuuauuuucaucuuuauuuuaucauuuaaaacacauuuuuuuuuccaaugagaguacugaugacauaaaagguuauacauugaauaaccacccaaauuagcaguguuucauauuuacacuguucaacacaguucucuugucucuguucaugauauaacaguaaauccaaguugcuuuaaguagauauuggaaauaugaacccaauauguucuuaacaucuccaugucguaauucuaauuuaaaaucaaaaucucaucaaauuacauuuuagauuaaagcauuguaccuaucgaaagaagagaaucgaaaaugcgaaaguccuucauuuucaguguggccugagauuguugaaggauuuguucuauugcaugcugauaaauauuuaucacgguuaagugaacaaucauuuggagacagacaccauuuuaugaugcagcuucucagggcguccuaauugugacucugccuugccauucuauguuuuaucggaauacgcagacauauacuuuaugagguuggguaaugaagagagagagaccccaauaaacauauuuucuaagaguaaugguuaucuauagcucaggaacccuugguuagcacagccucuauuacacaguacuaggcaagcaguucauagcucaauuagaucuaacuugcuucauuuuuaggcauuauguuauucuaaauuaacacuguauuucauauucuccaggucugacuauuaaccagauuuuggaaccuuuagggcuuauuauuuaguaaucccugaagcucucaaguaggcguuuuuaaauucaugcauuagaacagauuaaaaauuagcuagaaacgcauguuaaauggcccacucccuuucuuuugcuaauugugcuagaaaugaaaaagaaaaugcaagugaggucagaucuagugugguacaaaugaacuugcuacuugguuugcugccaauugcugccgaaacaggaguuauuuaaauuaguaaauaauuuuugaaaucuucuuagaaugucacaggccacaauucaaauucacagaccaggaaugguuauuauuucuauauaucuuaaaguuuucugcaauagaaaugcauuucaaauauaagcuagaaaaaaaaaaugugaggccuuauuguguagauaaaagugacaagauguccaaauguuuugaaacgcagugauuuauuuaaguuguagaaagcuugguuuuauuucuuguugcaucgucuuuauccuuagaucuuaaucagaaauaggaaaauuuucugagagaaaauucacgagaucauucaugaugagucacuauaucaguuacuuuaaaaaaaaaaaaaaagauccugacaaauccuacuuuuucagguccugaugcacuaagucucauucacuucuuucuauuuuuccucucucuauugcauauuaacccaccauauugagagaauagaaacuuuugccuucauuauaucaccuuuacaccccaggacaggugcccuccucagcggagacaacugucccccuccauccugcaggaguuuugcagccauccuuccagccacugcuucucuaccggggcaaauuuucccccaagggauaauugauaaugucugaggcauuuuuaauugucacaacuuggggaaggggcaagggauugagggagagugcuccuggcaucugguggguagggguuagugauaggguucggcuguguccccacccaaaucucaucuugaguuguaguucucauaauccccacgugucaugggagggacccagugggaggugauugaaucaugugugcaguuacccccaugauguuuucaugguagggagugaguucucacaagauuugaugguuuuauacgaugcuuuuccuccuuugcuuggcaccucuccuuccugcugccguuugaagaaagacauguuugcuuucccuuccaccaugauuguaaguuuccugagaccuccacagccaugccaaauugugagucaguuaaaucucuuugcuguauaaauuacccaggcuugcauaugucuuuauuaguggcaugagaacagacuaauacagucagggaugcugcagaacaucuccaaacacacaggacucccacccucuacuuccaccccaccaacaaagaaugauucagcccaaaauggcaguagugaccuuguugagaaaugcuguucaagccauacgucaccauuggaagguugccaaacugugcuuugcacacacaugcugucugcacgccuuguauuuuucucuuugcuuaguccugcucaugcucucuaaacaccccagacaucauaucucuuuaagaaacucuggcugagucccauaauguucuggggcaacuucugucuucccuuuucccucuggcaaagaauccuugaccaaacuuuagcucagcuccucagagcccacuucucaacuagaccuugaccuugcuccucucuccuugcuggaucuucauaguccagucuuuguaagagucauucuaagucagucuagagagaaucccuucacccuucaugucugaucacccuugccugccuucagcaaaaauccugcuaacuugguuaaguuggaauacuccuacccuugugguuccuuguaguaauuugcauccacugacccucccacuccccugcuacucuguuccuugacuauaaaucuccagcugucuuuauuauauuuggaguugagcccuaucucucuccccuauugcaacagccuugaccccuguugaaauaauccugcauaaagucuuccuuaccauuuuaacaaaugucaagguaacuuuguuuuuuguuuuuuuuguguguuuuuuuggagacagggucucacucuguugcccaggcugcagugcagugaugcaaucuuggcucacugcaaccucugccucgcaggcucaaaugauucuccuaccucagccuccugaguagcugggauuacaggugcccgcccccaugcccagccaauuuuuguauuuuuaguagagaugcgguuucaccauguugaccaggcuggucucgaucuccugaccucaggugauccauccauuuugggcucccaaagugcugggauuacaggugugagccaccgagcccggccaggauaacuuuuuaacaacccccccuccacacugccaacuuuuugaggaccauguguuguguagggccggauauagugcacauggugaacacauaaauaauguuuguuggccaggcgugguggcucaugccuguaaccccagcacucuggaaggcugagucagaacgauugcuugagcugaauuguucaagacugcccugggcagcacagugagaccccguaucuacaaaaaauaaacaaacuuagccaggugcggaggcauucaccuguauuccuagcuacucaggaagcugagaugggaggauugcuugggcccuggacgucaaggcugcagugggccaugaucgugacacuguacugcagccugggcgacagaaugagacccugucugaaaauuaaaaaaagaagaagaaauguuuauugaaugaagacaugaaagcauuugguggaaauagggcacacacaugaauauauucacaguugcaaacucagaaggauacucccaaccugguucuuugucuugucccuccaucugggugcuuuccagucacagccuggaugcauguaugaauaaacuucuaccauuaagucccugaauuauuuaagcacugccagugauucuauauaaaccguucaguaaaaugaauggcauaugcguauguuucaagagcuccagcagccuacccaggauggcuugauguugucucuuagcaccguaucaauaccuggggguuuucaaauauugcagguggccgaagccuuuguguugagguuucuguaguguuuauccauuugugaaaccaggccucaaucuauauguccaacgccauucguagacccccuuugauaaucuccacuaagcagacauacucgauacaucuucacuaaugaguucugacuucauaaaauguauuaaugacuucuuuuugaaaguaagagugcuuugaauaccagucguuauugcuuuagaaguucauaaaagcaaaagcacaguauuucccccaguguuugugcgauaagagaauagauguagguccagcgccuagaauuuuagcuaugcuucucuuguuugugauuccagguuucagacugccugguagaaggaggucacuucugauugucagugacuuuggugaguucuuaccuuguaaaagauuuacaauuauuucauuuucaacauagcuuuaucuuaugacaaaggugacagaaaggaaaucuccuaaguuggccuacagggugcuuuagaaaacaucuggcugggcauggugguucacaccuguaaucuccacacuuugggaggcugaaguaggcugaagugggaggaugguuagagccuaggaguucgagaccagucugggcaacaacgugagauccugucucuacaaaaaauaaaaaaaauuaucuggguauaguggugugcaccugaagucccagcuaacugggagucugaggcaaggaaauuguuugagccuaggagguugagagugcagugagccguguugcugccacuguacuccagccugggcaacaggacaagaccgugucuccaaaaggaaaaaaauaauaaagcacugucucucucuacccuugcaguaucccuguaggagagaguuacuauuagcucccaguuuauaggugagugauaugguuuggauguguccccacccaaaucucaacuugaauuguaucugccagaauucccacauguugugggagggacccagggggagguaauugaaucauggggcccagccuuucccaugcuauucucauaauagugaauaagucucaugagaucugauggguguaucaggaguuuccgcuuuugcuucuuccucauuuucucuugccacugccauguaagaagugccuuuugccuaccaccauguuucugaggccuccccagccauguggaacuguaaguccaguuaaaccucuuuuucuucccagucucagguaugucuuuaucagcagcgugaaaacggacuaauacagugaggaaauccauguguuaggaagggagugugguuguacuucaaccuggaacugucuaacuccuaagguuuuauuaauaucuaguccauuucucucaaucuaauaguaaauggaagagaagcaacaacuuuuguuuuccaauuccuuuugaacauuugaaagguuuucugaaaggacuuaaagaaaccauagcuuccuuaccaguucccaaagcuucaguccuuaccaaaguguacauugccuuuaaggagauuuguuuccaucaaucccucccauuuacaaggaauuacagaagagugaugcccccuucaaaguggcucacaccuggcugacaucuguucauuaagaaugccugccuuuggguucuaagacguccaaggagcucuuauggguaacaccuguagauuuauagacguuccucucugacuguaagggccauaugccugaaucucucacccccauguuuauaaaacuuaacaauuguggaagcaaugaauugaaggacuagggucaccaguggagucccauaaauagguuguuuaugaucccugugaaacaagaagacccucuuaauuucaugcuucuuaaacugggguaugaguggccccagguuucccuguuggggguacugauaccagaguucauuugaagucauuggaaaccaaggcauauuuucuuaaagagacaacuguuuuuggugaauaggccauguuguuuauaguaaaaacaaacaugaauauucuguaauagaagauaucguuugcaugguguuuuaaagcuaaaacuugaguuauuaaacacccuucucucccuggggaugccuuuugcuaugggguugcauccacggaagaguuugaaagcccaaccauauggacaucauauuauucauuuuuauuugccauccagagcuugccagcaaccuuuuagaucucuuuccuuggaagguucagcaagaugcuuguaaauguauguugcuuuguugcagacaauguauauuuaaaaagcaauuauuugcccaucucuuguucaacucagauauugacugccuuucuguauuucuggcugggcauuguuuaucuccaccucaugguuuuuacuaugguucuagaggucuagccuacaaagagaaugcuucccguccccaccacuacccacaggacccucugcauaucucagaggaauuucucaguguuccaguuaauuuucucucuguuuccuuuauuacuucuaaguuccauugcaaaaauaugcugccugcucugucagccacccuauaugccuauuuagucccaguuuuccagcuucuauuuuuuuccacauaaucccuaaccaugauaauacaaauauaauagaaauaauuauguuuguuuaaaauauacacagaaccaaauagucauagaguaguauuucagguggggggcccuccucuagggcaguggagacaaugucaccugucgggaacauuuggcaaugucuggagacauuguugguuguggugcggugacauaacuauuggcaucgaguggauggagggcaggugugcuacuaaucgcccucuauugcacaggguggcccuuaccacagagaacuaugcagcucuaaacaugcgcagccccaaggcugagaauuguugaucuaggggaagaugugauuucauucuucaugcuuguaaauuauuauuuaagcugugaauacccucucuuuucccacugaaguugugguuguaagauucucagaguuaagcagacucggcaacauuacagaaaaaaaaucaagauguaaaaaggauuuagacgucuggacgugguggcucauaccuguaaucccagcacuuuaggaggccgaggcagguggaucgguugaggucagaguucaagaccagccuggccaacauggugaaacccuguuucuacuaaaaauauaaaaauuaccuaggcgugguagugugugcauauaaucccagcuacucuguaggcugaggcaggaggcagagguugcggugagcugagaucgcacuacuucauuccagccugggcaacagagagaaacugugucucaaaaaauaaaauaaaauaaaauggauuuagaaaugguacagucagagguuaggggucgggucaaagcgauccccccagagaccuguggaaagugugguucugucuacaagcugcgaccauggucuuuacugcuucugcaaauacuugacaaaaagggccacacucuuagcuggacuuuuccucccuuuccugaaacaaugcccuucccauugucaaggcagaagcagccuccacugagaagcgucagacaccacgucagucuugcuuuccauugcuuugcuccaguauccauuugaaauucagugcaaacccauaaauuccacuuugccucugguagcagccugcaugguguguauauugaacacuagaaacacaguaaauccagcccauuuauucacauuaaccagcaaaggcauucugcaugcccauguaaauacuggaaauuacugacauggccuucuagaccaugaaaagacagaagcauauggcagaauucauaugugaacagauugcuuuuucucauaagaacgcuuuauuggaauaucaacuauuacagcuuuuugaaguuacucuuccugcucuugauuuaaguccugaaucaccccacuacucuuuuuuuuuuuccgcugcauucugcuauguaucuuuacaucugcuuccugcacuuucuaaauggccuacuuaaaccuugagguagguccuucaguuucccauaaauuaauaacacaucuaugaauauuucccagccagucuuagaagccccagucuauuccaauaccaggauuguaaacacagggaauagaugaagcaagcugcuucuuucaaaugcucuuccaauaugaagcaaaauauuauugaucuagacugccugcuacuuucauuuaccauguuacuacucgugggauuacaggcacaaagguuucauaaauuucaaaugaaauaugaacauuuguugucaaaguacuguuaagguaugaaaacccugcuaguauuaguucccuuuuguuauuauucuauuauuauuauuauuauuguguuuacauccacaggcaaucacauauuuuagguuguggggagcaaagcagcuuccccccacuuuuucucucacuccaauuugaauccucccauaugucccucccucauuuuuuaagcaggaaacaaugaaugaguuuuugcuccucuugcccuauuugccgugucucuuuucugugauucgggagcacauugauacccuucuuuuggagcagagaagcuugucuuucaugauagaaguaggucaugggggcgguuagcugacuucaucagagaguagcaugcagaucccaccugugaggcuauggucugccaaggagaguucagcgggcuggaucagagagagcagagccaugcuggcaagucggagucuuuguggaaagcagccaaggucacagcuggaaauaaaacuguguauuccaaaucagaggggcaaugcaggaauggaucaaaggaaugaaggaucaaguugucagccaagagaaccaagagccagacacagggaaccugugacaaaaacgaaaaccaauaaaaacauauauugagcauugaccaggugcccaauauuuuaaugucccaugggugugcaucagguacgcuguggaaggacagaugucauuccuuaaaggggcugcacugaauuagaccagggguucucaaaguggggucccuggaccggcagcaucaccaucaccuggaaacuuguuagagaugcagaucuugggccccgccccagaccuccugaaugugaaucucugguggggagggagacgaagugggagccuguaggcugcagucuguguuaagcuuucugggugauucugauacacggucaaguuugagauguagcaggagaagcaggaaacauaggagagaagccacuaggggugggaaucagaaauacggugucccugccuaccuaggggcuacauuccuccgggcaagucuuuuuaacucucucugccuggcaacuuccuuaacaaagagugauacuaauaccugccuuccugucuuugccacaucacgggauuuucuacagcucauauugguuacagugauagcagcugagauuuaggcugcaccugaguaccaggcaggguccuaagugacuucagacucuauagacagucccugacuuauaaugguuugacuuagauuuuuucaccuuugggaugcugagaaaaccauacacauccaguagaaaccgaacuuuacauuuugaguuucgauuuuuuuuuuucaccugggcuaguaauacgugguaggauacucucucacaaugcuaggccacagcagcgagcugcagcucccagugaucacaagggcaaagaaucgauauucuaccaggcacgguguugccugauaaccuugcccagcuguaggcuaauguaaguguucuuuuuuauauuuucuuuaauuuuuuuaaauuuccaccuguuuugggggggguacaggugguauuugguuacaugaguaaguucuuuacuggugauuggcgagacuuuggugcacccaucacucgagcaguauacacugcauccaguuuguacuccuuuaugccucacccuuuuaccacucuuucccucucaguccccaaaguccauuguaucauucuuaugccuuuacauccucauagcuuagcucccacuuauaagugaaaacacacagugcuugguuuuccauuccugaguuacuucacuuagaauaauggucuccagucccauccagguugcugaaaaugccaucaguucauuccuuuucauggcugaguaguauuccauuguauauuuauaccguaguuucuuuauccacuuguugguagauggccauuugggcuaauuucacauuuuugcaauugugaauuguugugcuguaaacaugcgugugcaaguaugucuuucauauaaggacuucuuuuccucugggaagauacccauuagugggauugcuggaucaaaugguaguucuacuuuuaguucuucaagaacucuccacacuguuuuccauagugguuguacuaguuuacauucccaccagcaguguagaaguguucccugcucaccgcauucacgccaauaucuauuauuuuuugcauuuuugguaauggccauucuugcaggaguaagaugguaucgcaaaugcaacaaaaacaaauaggugggacuuaauuaaacuaaucagcuuuugcccagcaaaaggaacagucagcagaguaaacagacaacccgcagagugggagaaaaucuauacaaaucuauacgucuauacaaggacuaauauccaggaucuacauggaacucaaauuagcaagaaaaaagcuaacaaucccaucaaaaagugggcuaaggacaugaauagacaguucucaaaagaagauacacaaaugaccaccauacgugaaaaaaugcucaacaucacuaaugaucagggaaaggcuaauuuaaguguucugaacacauuuaagguaggcucggcuaagcuaucauguugaguagguuagguguguuaaaugcauuuucaucuuaugguauuuucaacucgguauaggguuuaaucccauccuaaguugaggagcaucuguaucuguuuugguccugacaauaccccaugaaggaggugcaauuaccccuggcuuaggguugagaaaacuaagagguuuaguaaugugcuugaggccaugcuaccuguaagcaagaaucacuccagguuuuucuuguuucaaaacuccuguuaacaacugaguugcuauacuguuuuaguaggucaagauauacuauguguuucaaagggcuuauaaauuauaaaugcuacuuaaaaugauguaaagugguauuauuguugucaucauguauauauuuucaacucucucauuggcaucuugagguuucucuucuaugaaauucuuugcccuaggaugguccccuuugucaaagagagacacauucugaacaaggucagacaacacagauggaguuuggauucgggcacuggugacagugaagacucagaugagguucuugaguacuuucaauuagguuuaccacugaccccaucagugugcagacgaagggagaugagagauacagaugguuaaugggauuuuugggguaucuuccagccuuugugagcacagagguuucgcuacauuuugaaaauuaaaauucauuucauucgcauuacagauuuuaaauccuagcuccuuuuuaagcuuuuaauuccaacuugcauuucuuauuauucuguuuacaaaccugacaaauuuuagcagucguuuugaggagaucuagaauaauguuucaucucauuuuugaauuuagguacagaccuuaaaaauauuaugcuacauuucuaauauuaauaucuugcuuucuuauuuaggaacuuuuccugacaaacuucccaagaauguaauuuuguuauauccauaugauaaaccuuaaguauucuuaagccaggugcaguggaauuccccuguagucccaucuacuaaggagacugaggcaggaggauugcuugaggccuggagaucaaggcugcaaugagcuaugacuauaccugugacuagccacugcacuccagcugggcaacauggugagacccugucucuaaaaacaaacaaaccuuaaguuuucuuaauguucugacacuuuuauaaauguaguauuucaacuuauggucaccauucuguaaugauuaucauuuguacauuuaaaauagaaacuguuaggccaauguguuauucuagaauaggacuugacagacuuuuuuuuaaauaaaaugccagauaguguuucuagcuuugcaguucagaugguguguguuacaacuguucagcucuaacuuuguaugaaaguagccauaggcaauacacaaaucaaugcaccaucuguguuccaguaaaacuuuauuuauaaaaacaggucacgggccacauuuggcccaucagccauaguuucccaaccucugcuuuggaaggccuaacucaguuaaacauuacaaguucaugcagcacggugugauggcucacgccugugauccuagcacuuuuggaggcuuauguggguggaucgcuugagcugaggaguuugagacugggcaacauggugaagccguguuucuacaaaaaauacaaaaaaaaaaaaaaauuagccaggcgugguagcuugugacuguacucccagcuacuugggaggcugaagugggaagauauccugagcccaggaggcagagguugcagugagcugagaucgugccacuguacucccacaugggugacagagugagacccugucucaagaaaccgaaaaacgaaagaaaaacaaguucaugagauaccacauacgugaauauaugcuaacacagcagcauuauuuuuugguuaaucaaugauuaucaaugcuucugugauuuuaaaaaggagagucagcuauucccucuucugcccgcugauaucuacagccucuaccagaugguaccucacuuaauugagguuugccuuuuuucaggcucuucuaaugaucuucuggccaacucuaaaucaccuuuaaacuucauggaauuuaugcauucuuguuaauuuauauccauguaauaucaggguauuucucuuuguagcugcaucuucuaagauaaugguuuuucauggagacuggcauugucccgucccuaugagggggacauuugggaauggcauuuuuaguacucacaagguaacuggggcacucuuggucuuggggaggggagguggcuggggacgcagaggguccugcgguggguggauacuuacaacauagaaauguccuggcucuugaugcuggcuacacccucaguaagagauacuguccuagggucauuuuuuucaacccacacuaguuacguggacugucuuagucaguccaggcugcuauaacagaauaccguugacuggguggcuugauuuuuuuuuuuuucucccaguucuggaggcuggaagucagaugucagggcaccagcaugguugguuucuggugagugcucuuuucugcauuuguggacagcugccuucuugcuguguccucacuuaguagacagagagagagagagagagagagagagagagagagagagagagagagagaccaucucucuugugugucuuucauucaugagaacuccaccuuugugaccuuauuacuucugagaggcccuaccuccaaacaccaucuuauuggguguucuaguuuaacauaugcauuuggaagagagaggaacauauucaguccauagcaugaaccaaccacgugcacagaggugugccccaauuuacugucagugcagccuucacaggcaggaaacccaccagguccaaggaaggggcacucagcuguuaccuccugucauaggaccauuccucacugugccaucauauuauacuuccauaucgugugucuuguggcauuccugggccugcagugagccuguggccaccucauagucuuguuggccacagccucuagaaccagggauuggaggaacagccaucgcuagcauggugcuuggcacugagcgggugcuuagugaauauuuauugaaugauuuccaacuaauggaagaaagcugaauagcacaacacccagaggauugagguuuauugaaaaccaacccaaagggcuauggugaaaaucaucucaaaaggcagagggcaagaaauugauauuuauugagggcucucaguggguguuguagggggaaggaaguacaauguccuggagcuaggcugccuagguuugaauccagggucugccagauguagaugugugaucuugggcacguuuuucaaccucucugugcuuaaucuucuccucuuuaaaggugggcuagugauaguuaccucacaagguagcugugagaaugaaauaaugauacauaaagcacuuauaacaggaccuggcaugcagugaguaucaguggguauuugcugugguuauuuaguuaucuacuuuacauguacauguaaagaacuagggauaucuguauuaagacagggucuuguuauguuuccugggcugaucucaaacuccuaagcuuaagugauccucuugccuuggccucccauagugcuggcguuucaggcuugagucacuguuccuggccuacuuaccuucuuuuugaucuucugaagucacccccuccaucugacaggagguugaagguccgauggccacauagguggcagugcuggaauuugaacccaggccuuccucccuuaccucucucuaccucuaucucuucuaucuaccugucucuacucccucucccuacuuuucucuuuuucccagccuccccccgauauacucaacauauaucucccucucccuccacccaccugccucccccacacuccuucuuucccucuccucugcagggagagcuuggaaaccaagagucuaugagcucgaagggagcaugcaaaggugccaggcaggcccucaaagcugggaagcugcaguagggguucuuugggacccaguuaagcagugggcccuugcucugagaugcagucugcugagcugccaucuggggacacaucuugaguuucucuccaugauggcgcagcucucagcguaaagcagucuauggagugagaagggaaaaggccccaguaauaaaaggcaaaggaagccuggugaagugacucauaccuguaaucccagaacacugggaggccgagaugggaggaucauuugagcccaggaguuggagacuagccugggcuacauaaaauuauauauauauauauauauauauauauauauauauauaaaauaaugcagaaguuuuauauauauauaaaguuuuauauuuauaucuauaaaguuauauauauauauauauauauauuuauuuauuuucaagacaugguggcaugcaacugcagugucagcuacuccggaggccgaggcaggagagucacuuaagacugggagcucgaggcggcagugagcagugaugacuccacuauacuccagccugggugacagagugagacuuugucucaaaaauaaaauauaaaauaaaauaaaaaggaagaaauagccaguagugcuuucuuguagacagagaagcuggugaaaugauguaaccaggcugggcaugguagcucacgccuguaauucccaguacuuugugaggcugaggugggcagaucccaugaggucaggaguuugagaccagccuggccaacaugauaaaaccccaucucuacuaaaaauacaaaaauuagccaggcacaguggcucaugucuguaaucccaaaugcuugcucgggaggcugaggcaggagaaucacuugaaucugggagguggagguuguagugagcugagauugcaccacuguacuucagccugggcaacagagcaagacucugucucaaaaaaaagaacaaaaaaaaaaaaagaaaugauguaacugguagggagaaagccaaagguuagaaagagaacaugaauugagaauggaaagaucgcagaggaagcagauuugucugcacaccucuugcauguguauuuggagaagcucugugugcugcgggucgagggaaacacauaacuggaacaacuguccuuuuccaccauuguuaaauccugcuuugcucacugcaggagagggggauuauauaggagcuucuggaaacagaugccuugggagcucuccuccuuuuccagaacucccacacuugcucuuguagaucaucauaggauaacucuccgcucccuuuccuaagaaaauugaucuaaaaaguaauuauggaaucuugcagugcuuguugggaucagagaaggcuccuccgaugaugggauguuagguagagggcugcagggaccuugcuuuuagucaggaggcaaaucaagagccaagagagggagggguggucgugaguuuuuaugauguuccuucucuucuccgcuccuuccugacaagagucugucucuuuucucugugugucauaacuacccacauucaccccggcagcccaucuaccuuguuucucucauaagucagcuucucucccaucuuuccugugaaaauuucuaacaaaaugggaguuaaggccgggcaugguggcuccuacuugucauuccagcauuuugggaggcugaggugggaggauugcaugagcucaggaguucaagaccaguguggguaacauagagacucugucucuacacauuuuuuuuuuuaauuagcuggggaugguggcuugcaccuguagcuccagcuacucagagggaggcugaagcaggaggaucccuugaguccaggaguuugaggcuguagugagcccuggucucaccacuacacuucauccugggcaacagagugagaugcuguuuuguuuuuguuuuuuuuuguuuguuuguuugguuuuuuuuggaaaaagaaagaaucaccauaaaaaagauggguaacucggaaauuucaaaugcuugaauuucuuggguugggaagaauaucccaaaauguguuuccaacuaccucacugauuuugacuucacagggagaauauuuugauuuuuaugcucugaguugcugguacugcugugggcacagaacuggguaugacagaacauuuuucugaacuaugacucugaucuucucaaucucucagugggaaagaguuuuggaacuuauuauuuuuaaaaacuugguaaaagauuuauaccauaauauuuaucauuuuaaccauuucucagugcacaauucaguggcauaaaagggcauuccuguugugcaaccaucaccccuauccaucuccaagugaacuugauucuuaaaucucccagccaucuguuucaauucacuagauguuguuccacccagcacgucaugguggaaaggggcaggcugugauuuuuuuuuuuuuuaaccuccagcagcuguguucccuguggcaacuauguaaccucucugagccucaacaucugucuauaaaauggaaacagugcaaccuaccuuagcauuugaugaucucaacuuggaucccauagcggguaucuccaaaauuuccucaucuugacuacguucuggugaaacuuaagaugucagcacaugaccuaccucccuucccuucucauucaucugcauuuucacaaugcuugguuuuaucuuuuauacauauaaugcacaauacauguagugccaacaagaauuauaguuucuguaaguaguguaugauugcccacggaucuucaguaacucauuaggcacugacgggcugacaugagcaacaacgagacuuaguaucuguugcagcucuccauacaguuuacgaaacucuaauccauaaaagccguuugaaauuuccauuaggagauuugcacaagugguuaaaauuagucaugcauucuuggucuaaacugcaggaaggguaucuuuacugugaaaaugauuaugacauguuaaaacuguguaauaguaagcagacaguuuuccgagcugcugggugaauucuggaaaugcucuauuauuuucucccuguugacuccuuucuuucaggcaagacagccagcauguugacuuggaaaacaacugaggcugagcaguuucagagcauugacauuacguggcuucuuuugugggccaccccaacucuuuuauuuuuuuuaauugcugcuucuuccucuaaaauacaacuuguuuuuuuuuuuuuuaaagaggaggaagccuuaaaaaccagcgacagucuugguuuucuuaaccuguccgccauuuaacauuucuagaagugcaacauugcuucuaagguaagggcaaggaccaugacuuuugcaugcugaaaaugagcugccugguuuauugaguuaguuauuccuuuuuagugccgcaguguuuucaguguuagagaaaaggcugugauuuucuuugauauuaaaaagccaaccacuuauauuuuccaaagccauuugcauucagucugacggccgcuaaaaauguauguggauuuuucaucugagagguuuucucuaugcauauuguuuacauuuaucaaauguuguccugcccaguacuuuauauucauuguugcuuccggaccuagcugacaacauggucuauaugaaaaacaacacaaaacaacacauaagagagucaaagggacuucuuuggggagaauauaaaaacaagccaaggcgaaaguggcuguaaaaaugcguuguguucccaaguggaggcuccuucuuuguucugucaucaguuugucaguugucaaucaaaccucccuucgccucacacguuugcuaauguaagaagugcuggcucugcucuuagccugcaguggugcagcuuaaaaauucugggaggguuucaugcaguaaauacuuaaaguaacagaaaaggacuggggaaaagcugauguuguagcuguaugaucacccauguaaaacuguuuauuuaguuauuuauuuauuuauuugcuuuuuuacuuccuuuucuaugccuuuggugacuuuguguaaugcuguauguaccaucagagcacauacugcuuuugugcacacauacauugaaaacaaaaugaaaaaacaagaauaaaacaaaaacccuauuccuauuccuacaauucugguacuuugccacaagguggugguaguguaucuugaguaaggaauaugaccugcuagauauaagcaucuguuuauuuacacacuaaggaauguuugaguguggaacgugguuuagaugcugugcguacagcagugacucagauagguguguauucucaagaagcuuucauucuaaugacacauacuuugucuccagucagaguuauggcagguuuuuuuuuuuuuuuuuuuuugacuaaauucacccauauuugauggcaagugugaucacagcauguuuauaaaaaucauucuuaauuaaggcauuuccaucuuaucaagcccccuauuuaauaaggauaucaaaaaagaaaacaguuuucgugcauauguguagcuuuuuagauucacuuuuuccuuauuugacccauauaaacuuugucugucugugucugucagucucacacacauccuucaacacaucucuuauuucuuuccagagccaggcuaaagcacccuugccaucuucucucucugcuguuaaauuagaugccuucuccaggaaucucucugggggcauccugagccuucccgauuccauuucagauuucuuucuguaaucaagagcuccaucucuguugcuuuccuggggcucuuccucuccucuuuuugaagcuuuucauuucccuuuauauucuuucauucgucaacuacaaagaagcugcaggcaggaacaagagagcucagcacacuuggugcagucucucuggcuugguaauuggucccaagaaaauaguuuuuuuccaauuauggcaacauugaaaacuuauccaggagaggaaaggcucuuucagcugcucuuucucgauccuugcaguuucccuuuugaccuguggguacacaugguacugacgcaauuggcaccucagaugguucuuccugacagcuacccuugcaacugacucaggauacaaacuaccuuuuuuuuuggagacagaucucacuuuaucacccagucuggaguguaauugacgcaauccuggcuggcugcagccuugaccuucugggcccaagcaguguucccgccucggccucccaaaguauuaggauuacaggcaucagccgucaugccuggcacaaacugccuuuggaagugaaucagucaguugccuaguaggccuaaggagaccaugauccauguaaaccauggaauauuuuaagcagaaaagaacguauuccccuucaaggacaaagugcuggaauaauugacauccagguuaucacagagccuuccuauaguguugauucugaucacucaaauaaucuuaguguuaaaggguuuauuuuuauuuuucuaccuucuuuuaccaccccuuacucccaucagagcaccaucagucuuuugggaauaaaauaauuccucagauauauuaaaaagcuauagaagcagaaguuaacguacaugcaaaaaucucuacauuucucaacaauuguguaaccacuaaauauagggaaagaagugugcaagguauaagacauuggccaugcguccuugucugugccaccucaccaggagcauugcuccuuuuuaugcacaagcaucagagguucuggacaucuucuugggcuaguugguauagcuuccuucucagcucauucugcaagguuugcuuuggaaaagucugugcaucugagcucucucuugccauaucaggaaccgaagucagaaauaaaggcuacagaugcucaaaaucugcaguauucaaucuuuuuaaggcccagcauggugucucaugccuguaaucccagggcuuugggagacuaaggcggguggaucacuugaggucaggcauucaggacuagccuggccaacauggugaaaccccaucucuacuaaaaauacaaaaauuagccuggugugguggugcacaccuguagucccagcuaguugggaggcugaggcaggagaacugcacucuagccugugcuagagagcgagacucugucucaaaaauauaaauaaauaaauaaauaaauaaauaaauaaauaaauaaauaaauaaaguaucuguccccaagucacaaugcuauucgguuggugcaaaagcaaucgugguuuuugccauuacuuuuaauggaauaguaaauaacacuugaucuuuggucuucugaccugaaaucccauggcuaggauugucagauagaauacaggacaccuggccuguuacaguggcucacacuuauaaucccagcaccuugggaggcagaggcaggaauaucaccugagcccaggaauuugaggcugcagugagcuaugacugcaccauugcauuccagccagagugguagagcaagacccugugucuuaaaacaacaaaaacaaaaacaggacaccugguuaaaugugaauuucagguaaauaacauauuuuuuaaaaauguaucccaugcaguauuuggagcauauacucuaaaaauuuucuuugggauauacuucuaagaaaugauuuguuguuuaugugaaacucaaauuuuacucggcauccuguguuuuuauuugcuagacguagcaccuaccugugacaucuuuuuguuucugcccugcugugucacagggucuugguaucuuuccuccugugauucugacacuaccuugggaaaugacucuguaucaagcguuuaccaucugcugaaagcuuugcauacucuguugcuuaucaugacaacugcccugaaaguuggguguacuuguuaccccuuuccagauuaaaaaaccuaggggucagagagguuaaguaacuugcucaagaccucacagugaacugugguggaccacugggauuagaacccagugaguucaguggcuuugccuccaagugcguuuauuauuguccgcacuccaaaauggcuuuaaaaaauuaaaaagauacaugacguugaaaucagugacagaggcauaaggcuccuugagggaagaaaccagguguuggccauaaaaaaauuauuuuucacagcgcccagcaaagggcuuguaugcaaaggacccucaguauaagcugguuguugacugauguguuucaagaguaagucagaaaaauaaaaagaaggcagggaaagaguucaaaacucagugucacuugcacauccauuuugcccuagaaguguuuuaaauuuuaucaggcucauaaacuauguuucgaaacgugaaaauaaauuggcccccugaccccuuaugaagugacaucauucaucugaaagguuuaucgcccugcgugucauuuugaaguucccuacucuccuccucguucucuaaauccaugaaaaaauagaaaugggaggaagaacuggagagagggguucuguguguguggaauguggcucuggaaagcccccagcccuccuguuaacacaaugcuuuuaucccguaaucucugccugcgggagacaaaauaacaguucaucuggaaaacaagauuaacucauuuaacuuacguagugaucacagagagaagcuuguuggaguugucuggcugaaggaaagcccgcgauucucggccauuccgguucacagggccuggguagcgggcccagccuguugcaaguaaucgggcucugucagaucagccuuggugagauugggauauuaccaggguauucuguucaucucugacacaggcccucucaaucugauagacggugugccucuucucuucauuagaacaucuuccugaacacuugccugucugcacugcccugcuaagggguuuucaggugagcgugcuguggguaccuucacauuucaggccuuuuaacagggaaugaaaaccaacugcccugugauuccaagucugcugaugcaugugaaauuggcuuuguguuggggccucuucuuccaaagcaacaguaagcauuuuuuuuuuuuuugugauaaucucucucugucacccacgcuggagugcaguggugugaucucagcucacugcaaccuccgucuucuggguucaagugauucuccugccugagccucccgaguaacugggauuacaggcacccgccacccgacgcccagcuaauuuuuguauuuuugguagagaugggguuucaccauguugcccaggauggucuugaaccccugaucucagguguuccacccuccuuguccucccaaaguguugggauuacaggcgucagccaccgcccccggccgauaguugccuuucuuaccagccugggccaggagcaguuguuuauuuucugcuauuucguguguuucuuuuugcuggcagugacauacuccuacagggaugucugccucauguugaccugcuuguguuuaccaccuagaggccuaagaacaggcuuuccccguucaaaucacccaguggcgugcacacuuggggcaccuggggacugguuuccugaauggcauugagagucauuacuuuccacacacaguuaacugcagggagauuugucucugaaaguagucuucaagaaaugcggcagcugcuucuagccgcuccauccuuccuuuucccagugcgcacuaacccuccagagccuuccgcaucugcuaugcagcauuggccacaccagugggaugcaagaauuuaucccuucuguugaugcaauuaaagcuaauggaucucauauauauauauauauauauauauauuuauauaaauauauuuuauauuuaaaaauauuuauauuuuauauauuuuuauauauuuaugcaaguauauaucuaaauauauaaaauauauauaaauauauacauauauguguauauauagauuuuguuuuuugagacagggucuugcucugucacucaggcuggagugcaguggcgugaucauggcucacuguagccucaaccuccugggcucaacugauucucucaucuuagccuccugaguggcugggaccgcagguucaugcuaccgugcccagcuaauuguuuaauuuuuuguagagauaggaucucucccuuuguggcccaggcugaucucaaacuccugagcucaagcgauccuacucacucggccucccaaagugcugggauuacaggugugagccaccaugccaaagccuaagggaccuuagaauuuuuucuccuuucuuuucacauuuuguuuugugcuugcuuauuuauugaaaucuggaccacaaauaacuuacauguuugucaaggccagauuucaggaccuaaccaacacccgacaggcaucuuagaaaguggaggguguaaguuauaaagagagauuacuuccaacacguuucuuuaaagccugcuggcuaaauuaggugggaccuucuuuguguccucucuguucuugcuagucuggccuuuguauaauagggaagcagauauaucuggaagccucuaagugugcaucauggaaauuguuugaaauguucaaagugauguggauguauauauacguuaaaaaauaucacuuucccuuuugaagacauuuacuauuucuaugguuuguuuagcaacagccuggcugaauaguucuucaaaaaauaggaacaugaugcucauaucuggccacuguauaugcuuuggagggaacuugaagacuagguggcugcagccacucagaaucuuguugaauauuuaacauuuuuuugugaauguaucaacuaagaagacuaucaauuuuagagcauacagcuguucuagaauaauaguuugaaaggccagccgcaaagauuguggugauuaaagugugagcagaugacggaaugauaaaccuuaacgcuuaaaaauguguuuuuauagugccauuccuauauaacaucgucugauaaauguauuugagacgaacaggccaaaugaaagaaccuuccauaaggggacgcagcacaguuugaauauaaguguucccuccaauucccauguuagugcuuuacuaugaguauugaccaguguuaaagagugagcgcacaggagccuucucaaagccuccugcacacacucucccacuguaaaugcacgaguauugaucacaauuauuccguaaacacaucuuacaaauucccucagugcacgcgccaucuaaauuaauccaaauucagaacaaagcucucuuggaaaaggaaagagcaucucuuucaggagcuucccucuuggacauuaaaucuuccauaaucugugcuaguucggcaaagaagccccaacguccucccaaucauagggcgccugagcucuuggucuccuauaucuuauauucauuauagaugucuuauauccauuccuguauccuuugugaugucuugagugagaaaaugcucugaccaauaagccaauguucaauugacuucgaaauguuaugugggauaggcucauucagggugguacggcuguagacaaaaugcuauaugcauuggcugggcgcgguggcucacaccuguaaucccagcacuuugggaggccgaggugggcagaucaugaggucaagagaucgaaaccauccuggccaaccuggugaaacucugucucuacuaaaaauacaaaaauuagcugggcauaguguugugugccuguaggccuaguuacuugggaggcugaggcgggagaaucgcuugaacccaggaggcggagguugcagucagccgagauuauaccacugcacuccagccuggugacagagugagacuccaucuuaaaaaaaaaaaaaagucuuauauugauuaaaagagacuuaagacacauaguaccagauggauugugugaugcucauuuugauuuggauuuaggggaaccugcucucaaagacauuuuucugagacaaauaggaaaauuugaauauggaguagcuaauagauaguauuaagagaguagccuucauuuuuuaaaguauaauaauauuuuaauugaguuuauguuagagaugcauaccgaaaaaucuacaagugaaaugauaugauaacuaagacuugcuuuaaaauaaugcggaaaaaacuguuagaguaauagcguaaauaauucaagauuggaaaauguucauguuaaauuauuguuggccgacuguggguucauuuaauuagguucucuguuuugggguauguugaaaauuuuucauaagaaaauauuauucagaggucucaagaggcaggcugccaagaauagcaguuagaaauagcuaguaucaggccugguguaguggcucaugccuguaaucccagugcuuugacaggcugagggaggagaacugcuugagcccaggagaucgagaccagccaggguaacauagggagacccucaucucuacaccgaauuuaaaaacuuagcugggcaugguggugccuaccuguggucccagcugcuugggagguugaggcaggaggauugccugagccugguagagguggaggcugcagugagcugugauugugccacugcacuuuagccugggugacaaagugagacucugucucaaaaaaaaaaaaaaaaaaaaaaaaaaaagcuaguagcacaccccaaaacuucuagacagggcauggugugagcuggaguagacaacuaguucaugguaacaggaccagcagagcuccgucuugaugcuguuauuauuugguaucuguuaggagcugaauuauguguccccaaaauucaugugaugaagcccuaauucacaguaccucauaauguuacucuauuuggagauacagccuuuuaaaggaugguuaaguuaaaaugagguugcuuggauggucccuaauucaguuuaauuuggguccuuauaaaaagaggaaauuuggaugcacagagacaccaggaauucauaugcauggaggaaagaccacaguggcaaaagacacauugaggagguggcugucugcaagccaaggcaaggggccuccggagaagccaaaccugcugacaccuugaccuugaaugugcagccuucagaacugugagaaaaucaauuucuguuguuuaagccaccuagucugucacauuuucuuauggcaaccccuguagauaauacagucccauucucuggggaaacagauaccuccgccaggguccugaucugaauaugauuuggggugauggaacagaaacacccgaggacugucguuggggaacaggaaaccugucuguaguccuggcucugucuccaauuggcuacgagggcuuguguguacucuaguucucuuuccgugacacugcauuuggggggaagguaagggaacuggggaaaagaaggcaaaaugaugacuuaaagagacugaugaacccaaagcucucuugugaagccccuucuagaauaaguccgucucacguuacagugcuuaggaaguguuagauguacugucauuucuucaacauauauguccuauauuagucuauucucacacugcuagugaagacauaccugagaugggguaauuuguaaaagaaagaaguuuaacggacucauaguugcacauggcuggggaggccacacgaucauggcggaaggcaaaggaggagcaaaggggcgucuuacaugguggcaggcaagagagccuuugcaagggaacugcccuuuauaaaaccaucagaucucgugagacuuauucacugucacgagaacagcaugggaaagaccugcccccaugauucaguuaccucccaccgagucccucccaugauacguggggaugaugggagauacaauucaagaugagauuuugguggggacacagacacaccauaucaugucuuggcagccaucuauauucaagacacuauucuagguaugacauaaaggauggcaaaaagucaguuacuuaaaaguguggaagcagagugucccaggcggaggaaacgguaaaugagaccucugguaguaagaagcaguguagcauguuugagacacugaaguccaauggaacuugggcggaauaaaugaagggaagauucaaggugaaggcugagaggugugcaugggucugaucacacagagccuuguaaaccaaggugaggacuuaagauuuuauucuagcugcagugaggaaccagugagugguuuuaagccagagagagauugauaagacauggaaugauauggugugauauaugaaaugacauguuugaaaugauagaugacgugauugugauauaauaucaugcggcugaggacaacacuauaacugcucgguagagaauggauugucauggccugggugugguggcucauaaucccagcacuuugagagcuccaggugggaugauugcuugagcccaggaauuugagaccaaccugggccacauagugagaccccaucucuauuaagaaaaaagagaauggauugugaugaauuaggauuggaaacacagagaucaguuagaagauuuaucagugagaaaagaguucaguugcaaguuaaagaaaacacaaguaaagcuaacuguaacacacagagcuuugucuuuucuugcugaauaagaagcugagagggaggcaauugcugucacugguccagccggcucagcaacugcacauuugucaaaguucuucauccccagcuuugugauucucuagguuauucauucuucugggaucguagauggccaccacagguucacuguggaaagagggguaggaauuuuuaccagcugggucugacuccaccccacccccaccccuacccaccguuuuuuguuuuuguuuuuuaagaugaagccucacucuguuguccaggcuggagugcaguggugugaucuugacucauugcaaccuccgccucuuggguucaagcgauucuccugccucagccgaguagcugggauuacaggcacaugccaccacacccagcuuuuuguauuuuuaauagagacaggauuucacuauguuggccaggcuggucucgaacuccugacuucagguggucuauccaccuuggccuccccaaauucugggauuacaggcaugagccaccgugcccagccgugucugaccauuuuaucaggaaaagcaaaagcuuuucuagaaucuaucaacucccuucugcaugugucuauuuggcaugggcugugucacaugaccccugagcugcaaggaaugcugggauacgauggaagccugccagagguagagccuugggaagggcugauagggccucuaaccuaaauguccaccaccagagguauuacagagguuugagcaagaaauuaugguggucccagggaugaugcauucugauaaucauuaucaucaagaggaaugucuaaaggaaaggggaaaaaaaaaaucagacagucacauugaaaugagguccuuaagauaggcccuaauccaauaugcacauaaaggggaauuuugggcacagagacagaggcagagauagagggaagaugaugugaagaaaaacauagggccguguagaggcagaggcagagauugaaauugugcuaucaugaacgggggaaugucugggacugccagaagcuccugaaggcaggaagcauccuccccuccagccuuuggagggaauguggcccuguugacaccuugauuucagacuucuggguuccgcaacugcaaaagaguacauugcuguucuaagccacccagugugcaguagcuuucugcagcaacccuagggaugaaugcuccugccaaaugcugccugcccuucaagaugaguguuauuuggcagaggaagaugaugcacugcuuauuuuaggggaugcccucacuuuugggucccuaugucaccuguguguacuccaugccagugucuucccagccccugccaggcaaguucgugugguucugugauaacccucaucucuauagguucugugauaacgcuccucucacugugcugcuccuugggugacaucacacccaaggagaaucaugggaccaccuccagagagauuuucuuagagguguggaacagaaaaaaaagcgucucuauucgaauugcaggaucuuccuuauaguccuggagaaacguggcccagcauugucuugguccauagccugagcuuacccucccuacgcaaccacagcugugugcagcuucagccagguuugcuuuaccugaucucacuggcuucauguuuauuaucuuauuuucaguuucaaaagggcauauccugcccccuuucccaagaucagaggauaaggaaugucuugauguucucagucguaaaauuaggcuaauaacaccucccaugguugucugugaggacaacagaaaguaauguuuucucugaaaaguuuaaaaggguaaauggcuucaucacauggugaugacagugauuauuccaagagauggcuguaagcucccugagaacagaggugcucuguguaaaucuagucugucuccccaggcuuagugguugaccuagacuauaccaagaguaaguguguuuuuuaaauuuaauuuaaaucaauucauuaagcauugcuaaauuggaaaaccauggaauauagagauccaguaguuaagagccuacugggagagacagcauaauaauuacaauaagugcagaacuugcaauaauguaauugaaauaauguaauacaauccugcuuaauauuacacuguauauauucauugacuuauagacugagcuccuuaucuuguucauugcuauggcuuuagcaccuuuugaacaguggugcuuggcuuuugguagguggucaacaaauguguauuaaguauaugaacuguuggaagggucugcugugaaggaugugauuugcucucuuugaugguggacaaagaagguuuccugguggaagagauuaaugaguuggguuuugaugaaugaauaggaguuuccccagacacacggaggagacagaauggaaugaaagagggguuuuccaagaagaggcacugaagggcaagacuucauugcuucuuugauacuccaaugccggcuuccuuuggguuggacucugauggaucuaaucgaggauuaggauggagguaggugggaacauauuuagaaggaugcccugugguuuuucuccuuccugcuauuuauauuucccucucugucuuucccaccuguuuggugaugaggaaggagcuguguacugguuugaaaccuauucacgacauaguggacccaacaccaagugucuuauuguaaauggauccacuuuuacuacaguuacuuuaauggcaucuaaaugauaaauguuaauaagcauuuuugcuugggaaagcacaaugguauuagccugccagacugcaaacguuauuugcuuuauggaaggggauuucaaacaagggguucuggugguuguauuuuugccucaacgguuauuuauagagaaaguaugggccauugcauguuuauaguaucucuuuuuuauggcugcccaaguuauuauuuuuuauugguuuggguacuuaauuugcacauuuguaaacaauuauguaguuacacagcuguuguaccacagagaccauaugcauuuccauguuaagagaaaaguccgugagggauucucacuggauaccaucauaaaagaauuauuguggugccaaaaaaauuuaaaaaaacgacuagcucagaaguuaucauuguguuuuuauaguauuuggaguuaaauaaauuuaauguuuuuuugcucacuugaguuggagccaaacuuuauaacugaauaggaggguucucuuucccauauuugaguagaacacaugauguucaauaaaaaugaauuugccagucagaaaaauuuaucuuuuagaaaauuaauacacugagccaagcaugggugguccaugccucuaauccuagguacucuggagggugacggugggaggaucccuugagcccaggauuuugaggcuacccugagcuaugaucacaccacagcacuccagccuggccaacauagugagacacuaccuagauagcuuaggagaguuccaauguuucugaaggauguuuuuuuaaaagaaguauucauuuaggugacacauauuuauugagacacuaauauaugccaggaauuauucuauugguuccuuuggaggagacaugaauaaaggcauggaugugacugaggagguaaaggugaagaauuggggagggguggauggggcugacucaugaccuaaagaacauggcaucuggggcucucuugaaauaaucugcacuaaccacucauucacauuuuuuugagucuguaagaucccaggcacucuugguagcagggggguuaggugggugaagggacaaguagaacuuaguuccaacagagcuaaaggguauuggugaagacuaugagccccucaugacgcacaacugguuucaaauccaagcccaucauguaucaucugugugauugugggugaucucuuucuucccaaagccuguuuucuugccugaaccugaucaacagaaacagucagugcagguaauguguuuagcacacagccuggcauacgaacuuccacacaaaacgggugaccauggcugaaggguuauucuggggagccuucccuguggaagccccauuaaccaucccugcucauuccucccgugagaccaccauuugcuaaaucuucugucaggugaugugggauccaagaagaaacaauaaucagaagcuugccuuacaggcaugcacaauuucggguggacugucacaugugcacugaaaaagucgagaaauguuaugauggcccuggaaggaggagugucuagaugaaaugcgaauaaauaggagacaagugugucguuaauuaagaaggagaagggggacuuuaagguuaccuuaaaagaaaagagaccccucaaugcuuuggaagagccuuuuuaauaagcuagucagguaaguuagauugcucugucuuacacugguuuaguaauuuucauauauacuuauuuccucugaaauguauuaguaacauuuguaauuuaccaaauggaaaauaucacuuaacuuuaagcuucaucaaguuaagaaugaauuuguaaccagggguauuauguuuucucuuauuauaacaaacaccaaucaaaaacaaacaaauacaugacgggaaagaaagaaaacccagcauuuauuggcaguauuuuucugcaaaauauuauuuguuucccuuugcaguuuuauucauuuuaagcacguuuucaccaaaguguucuauucuaagcuagucucaauucaauuuaaaguggaagguuuuuuucaguuuagauaauuuacauauaaaagcguuacuguacauuuuaugaaaugacuguuuucagaaaacaacgauuucaauuuaaucguauuguuauucugcaaguugaaaugccucacucuugcuucuuggucuuacugacaauauuccuucuugcccuaauuuuaaauggugaguguuugaaaauugaugugcuucuuuuagacccuaccaguaagacuuaaggcccacugugauucgucugauagacuugaagauuaugugcgcgugugugaaacaagggaaucuuaaucaucugaaccugacgguuauauagaucuuucugaauuauuuuucuuucuuuucacaagaaagaauuauuuuucuuucuuuucacaagaaauuuugcuugccaauggucagaucuguuaacacgaaaacuaaaaacuuauacaucauuuuauauuuugaaauucccaauuugcaauguuauuuuuuuuucuucuuuuuuuuuuaugacacuuuucuucuggaaaaaauccuuaggacccaguuacucucuuucaggauuuuauaucauaaugugucugugagagacagagccagauguucaggauuucagaccaccauauuuguccuaggaaaccugccagcauuucacauucuugacccuugaauugaauaugaggcucugacuauauaacagaaaacacccgaguuuuaugauucugcaagcgugguuuacacuauaaauuuccaccggucucugcuugucucuucuagaauuuaggguuauucucaaacucuauuauacaagcagugcccaagugccuuccuccaaaaguacauuagauacuuucuuggggagagaagaaauuagacaggagcuacaaagauggauuaaaauuaauuugguccuaacuaaaagauaaguuccucccccauccucaggaugaaaccaagagcacuucuccaucaucaggggagccaaguggacgcuaaucaccaccgugccuggagaguugccuuucagcuggugaauuuacuauugccaacuccugcauucuuauuagucuauaagauugaggucguuuauuggugaucacuuguagauauauauuuauauaaaucucuuagcccagaaucuccauaaacuguuuuucaugauguggauaccacgugggauaugucccacaauuggcaagugccauaaauauauuauaggccauuauacuuucuacaguaucuuuaauugauaugccccaugucuaagaaaaaaaguagcuuucaugaugaaggugaugaacuacuucuuuccauuauucuauuucccccuuuucuucuucaggcuuuaaagauaucauaauaccauuuacauuuacuguuuaauuuuuaggucuguauuuaaaaaucuguguagugacaacaauuauucuuauuguaugaacauauugucggcuggagaguauucagcugucagacaaaguguucucuaaaguguucagccaucagacagaaacucuauugcugguggcgggguugugggcugggggaaccagaguauuugcucuucuuuagaagucaucaaugguaagccuagggcagccugaaccacuuguguuagaaauauuuuuuauaaagcaggacaugugcuuugaaauuugauuccuccgucacuggcugugugaccuuaaagaaauaaauugaccugccugagccucucggaaauauuggcuggccaguagcauccucacagaguuuuucugggaaucgaaugagagauuacauacacagggccagguacauagcaggugcuccgaagauacccccgacuuccuuuccuacgaauaaagaggcccaacuuuuuguccauaugaagagguuggcagagcaaacgcacacgugcguaggagcuggaauugucgauaaugucacaaucucaggaaacccaacuuuguaaaugugacuuuccuuugcuacuuuuugccuauuaagcagccauguauguaaaguauuaaauuagcauccaggcacuuucuuuuuuucuagaaggugguauuuugcauauuaauacuugcuuaaaucaagaagcuaagacuuuguauuauauuuugcuuuacgugccuugauuaaggucaugauccugacauuccagucccaaaggagaccaaggaaaugaccagcacguggcucacucccugucuguccaguagaggacaccaaggcacgaugaccgcagcuccuguaguaguuauggucacugacuccggguucagacggacuugggguucaguccuagcucuggcgcuuaccaguuuucucaagugacuuugagcaucuuuacucaaggcucuuggucucaguuuucucaucuguaaaauggagaucgcaguaucuaacucauggguguguuuaaggauucagugauggagaaaauagcugaaaagugaccguaugaaaugagcagcaguugucaaguacuuggcauaguuccugucacauaggaagcauccaguaaguagugguaucuguugugauuaugaucauauuuuauuucauggaguucaguaagaguacaaagcgaggaguuuuucugccccuccaguagcuguagaauuugugugaugacuaugugagcuuauccccugguagguauaauggaaagacuaacaagaguagaagagggauguaacuggagcaugauuuaaaggaacuguaguuugucucuguuuuuuuuuuuuuuuuuuuuuuuccucuaaauaaacaaaggaauagaagauccugugaagagcugggugugguggcucauggcuguaaucucagcacuuuaggaggccaaggcaggaggauugcuugagcccaguaguucaagaucagucugggcaacauaaugaaaaccuaaugucuacaaaaaguauaaaaauuagccaggcgcaguggcucacgccuguagccccaccuacuugggaggcugaggcaggaagauugcuugagcccaggaguuagaggcugcagugagccaugaucacacuggagcacuccagccugggugacagagcaagauuuugucucaaaaaagaaaaugaugugaggaagccaggaaugaugaguaccuggauuaaacuaccuuaaggcugauugaguaaaagugaaagaucaucccgucaacugcuggccugccgcuuguguucguuaauagaacauuucccucugauugucaggcuuucuuagcagcuacagaauacuuauuuucuucuuuauauuauaaguuuaugccacugcaacauuuuagaaucaccugggaagcuuuugaaaacucccagcaucaugaagcauggucucuugccuuggggucagugucugucaacguggcuuuugcuaaagagccuuccccuaugagaagugaggcaggagaaggcggagugaccacaagaugcccugauggugccaagcuauuauuauaaaugaacugaagccacaacagaagucugcuaccuuguucuuaucugcauguuucucucuuuccagccucaucuucuacuaccuucuucuacucccacacuucuucuaccuugauucccagccuucuuuucuuuucuuuucuuuucuuuucuuuucuuuucuuuucuuuucuuuucuuuucuuuucuuuucuuuucuuuuuucuuuucuuuucuuuucuaccucucgggauucugagagcauccuguaauguuggaaagcuuucugcuaauccgggcauuggagugcucucuggguucacuccugacaguucuuuauugcuuucccaccucugccaaggucaaaaauggaacuugcuucuuguucucguaucacucagacuaagcaguugauguaacagauaacccccaaauuucagugauuucacauuuaaucuguaaaaaaugaggauuuguuuauagccccaaagacagucuaguuuggauuauuugaggaccuagacuucaccugcacagugguuucaccauccauccccccauggccuccaugguacccucugauucaggcucagcaggagcgggagaggaugcauaggacuacauguuuucugggccaggacuggaagcagcauaucucagauccaaccucuuuaccuuggcaaaaauucaggaugugcaggacgaggaggaaaaugggaguagugacuauuuagccagucuuugccacaucccgguucauaucucacuccgucauuuauaaccuguaauuaaaucuuuagugaguaccugucacagguugagcagucuucuagggccucugguuaccagcaaugaaaaaagccccauuugguaaaauacaguaguuggauucauuaucucugugauuaacuugcauaaaaaagagacaguuuucauugaugugaccuuuagcaacaacuccuaaaauauuuuuuuuccuucauuccugcuuuuccuuguuccagaagaaguuaagguaaauggcuuuuagcacauugcacccccagcuuuuagcacauugcauuaucauuauaauaaauguuuacgguuacugauauuauuauaguucuuuaucgacauuauuacaguccauuauuuacaguccuuauguuauuuaggaggggaauuuggggacauugacccacuuauguguaguccccuagugaaaugacaagaauccccagagcugggaaaacauuuccaugcaauucccucucaguuuacaucaaaaucagcucgucacccuugagauugaagcucgcacucuguaagcucugaauaaauauuaaccaucuccugaacccugaaggagacauuuucuggggagcagugauuugaugauuugaugaaguuguguguguguguguaguuuuucagacauaucuccaucugauucuuaccucuaagaguuccucaagggcaauuguguugcuuuguuuuuccuugcaucucuggaggcugagcaccuaguagugauuccagguacguagcagguauuuuacaggugcuuguugcauuaaugcacuuuauuggugauaugguuuggcuguguccccacccaaaucucaucuugaauuguagcucccauaauucccauauguugugggagggaccgggugggagaauauugaaucaugggggugguucccccauacuguucuugggguagugaaugaaucucaugagaucugaugguuuuauaagggggaaacaccuuucacuuggcucucauuuucucuugccuacugccauguaugaugugccuuucgcuuugcacuaugauugugaggucuccccagccacgugaaauugugaguccauucaacuucuuuuucuuuauaaauuacccagucucagguaugucuuuuuuuuuccuuuuuucuuuucuuuucuuuucuuuuuuuuuuuuuuuuuuuugagauggaguuucacucuuguugccuaggcuggagugcaguggugcaaucugggcucccugcaaacuccacuucccggauuuaagcgauucuccugccucagccucccagguagcugggauuauaggcaucugccaccaugcacggcuaauuuuguauuuuuaguagaaaugggguuucaccauguuggucacgguggucucaaaauccugaccucaggcgaucuacccgccucagccucccaaagucaggugugucuuuaucagcagcauuaaaacaaaguaauaaaauugguuucuuaggguuggauggcuuaaaacaacagaaauguaucaucucacaguucugaaagugagaaguccaaaaucaaggugucagcacagccacguucuuucugaaggcuccagggaugaucuacuccaugccuuugucuuagcuuuuggcauugcgggcggugcuugguguuccuuggcuuguaggugcaucacuccaaucugccuuugucgcugcaugucauucacauugggucucucugucucuacuccuuuucuucucuuuuuucuccuuuccuuuucuuuccucuucccuuuuccuuucuuuucuucuccuccuccuucuccuucuccuccuucuccuucuucuucucuuuguucuccuucuaguucuccuccuuucuucuuucuuacuuuuacuccucccugcuucccuucccucccucccucuuccucccucccucccucccucccucucugccucccucucucccucucucuuuuucucuuucucucuuucucuuucugugucucucuuuucucucucucucucuuuccuuccuuccuuccuucuuuucuuccuuccuuccuuuuuucuucuuuuuuuuggaaacagucuugcucugucacccagguuacagugcaguggcaugaucacgguucacugcagccucaaccuccuggggucaagugaucuuccccaccucagccucccggguagcugggaccacagguaugcaccaccacacguggcguauuuuuaaauuauuuguggagacggggcggggaggucucccuguguuggccaggcugguuucaagcuccuggccucaagggauucuccucccucagccuuccaaaguguuaagauuacaggcaugaaccacugcacccagccuaucuuaauucaauacacaguagugcuuuuuguucccccaugggauaguagguaaauuaauggaggaagggagucaacuaaacaauuuauuugagcaauuaauggaggaagggagucaacuaaacaauuuauuagggcuuuauguaaagcccuaggguuaguugguugguugguuuuguuuuguuuuguuccuuuuuuuuuuugccaggggaugcugugguugaauuucccucuguggugagaguugcauggggcaaugaggagguaguccagaauaguucuauggaaauaggaggcuuucaguuucuucaucuguacaaugagaguugaggggagcugagucgggaguugaaauggucacuggguaucauuuccguggguggcucuaaccuguuagggcugucugcacagugcugagcuuuuguguuuuuggucaucccaaugugcuuuuccuuuuuccugagagcagcccucuacaucuuccgugguguaaguugccuuauuccagcacguggcaucgccagucccagugcccuuggcagaccaugcagaaugcauccauggaauaugaaaaaugaggcccaguggggcacaguggcucacaccuauaaugccagcacuuugggaggccaaggugggcagaucacuugaggucaggaguuugagaccagccuggccaacauggugaaacccugucucuacuagaaauacaaaaauuagcuggguuuggugacaaacgcauguaaucccagcugcuagggaggcugaggcaggagaaucacuucaacccggaaggcggagguuucagugagcugagauccagccugggugacagagcaagacuccaucucaaagcgaaacaaaacaaaugaggguccucaucagcgugccuuugacacuguccucugguccuggugaucugaauacaucaccacagaacugccaggguacguguuuccuagcccauagcgagucccagugaaagcagagaugagaaagaaaggagggacacaaggucuggguccugaguuccaguccgugggggcccuggugcuacugcuguaguucaugaaacauucccuucgauucuuugaacucucucauaccuuucccuuaaauucuucuuuuucccuuaugucaagcuucuuucaguaacaacugaaaggcuaauaguagugcuguguggggaggacuuuggacuuggggauuggacuccaugggagaggucagcuccuugucucccugguggugagacagggaaugguagaguguguccuaccuaugugccugccuugcucuacaucagugcuucuuggauauuuugguaucaggacucuaaacucuuaguaguuauccaggacccaaaauagcauuuguuuaucugggucauuuuuacugauauuuaucauacuagaaauuaaaauagaaauagucaaauucuuuauuaauucguuuauaaguaagaaaccuauuacaagugaacauagauaacucccuuccucuuuccucucucccuccuuccuuuuuuuuuuuuuuuuuuuuuuuuuuugagaaagggucucacugugucacccaagcuggagugcaguggcccagucacagguuacugcagccuuaaccuccuggguucaagugauucuccugccucagccuccugaguagcugugacuacggacacaugccacuacaccuaguugauuuuuguauuuuuuguagagauggggucccacuguguugcccaagcuggucucaaacugaacuccugagcucaagcgauucucccgccuuggccucccaaagugcuaggaugaugauaggcaggagccaccacaccuggccauggauaacauuucuauaaaauauaaccauauuuucaaacaaagagaaaaguggcguugugcuacauuucuucuccagugcuugguucccuagaagacagccagauucucacuucuuuuccugcauucagucucuugugauaucacauggcauguggccucugaaaaacuccgcugucuaguuguaaaagaauacaaguaaguagucaagugacaccuuagcauucugaugaaaagagcuuugaccucacagagcuucuggaagggucucagagacaucccugagggucccuugacugcacuuugacaaccacaggucuacaugaucuguauagccuuuuccaguuuucacauccuaugauuccaagagggaaaacaaucuuccuuguaaagagaguuaagugacauuguguccuugucuacacucagcugcuaauaugcuaugggaccucagguaugucacuuaaaccuuguguuggaguuuccuccuuguuacauggaggucacaagaauaacaaacuaugcauagaucaccuaauuuagucauuccaacgguguggagagauagaggauuaggauggacuuuauuuccuaagugagaaacguuggcuuuaguaaaaguguagugguuuguagggucaucccccuaaagauaucccgccccaccaaagauaucccuaaagacauccugcugguuucaguggcucaugccugcaaucccagcacuuugggaggcugaggcaggcggaucacuugagcucaggaauucgagaccagccuggccaacauggugaaaccuuauccguaaaaaaaauaaaaaauuagccagacaucguggugcaugccuguugucccagcuauuugggaggcugaggugggaggauugcuuaagccugggagauugaggcuguagugagcuaugauugcaccacugcacuccagccugggcagcagagcaagacccugccucaaaaaaaaaaaguaaaaauaaaaauaaaauaaauauauauaugcaugcacauccuaauuccuguaacacguggauaugcccuuacuuggaaaaagugccuuuguagaaugcaagcauccuuauggaagaaggucagagggagauuugagaaagacagaagaggaggaguccaugcaaagauaaaggcagagggugaaguugugcauccacaagcucagauaugccuggagccaucaggugcuggaagagauacuggaagaucucuuccagggccucuggaggaagcacaguccugcuaacucuuaauuugggacuucuggcuuccggaacugcaaaagaacaaguuucuguuguguguaggcacccaguuugugguaauuuguuacagcagacauagcaaacuaaugcaaaugggcuuugcuugaagucccucagcugcuaagggucagaaacaggauuugaaccuacaguuuugaggccugaaccugcuaugcagugcuuucuuccugauagugaaaccacuguggucccaaacccacagggcucuauuuagauuuaaacaagacuaugaauguaaacagacacagugcaaugccagauccagagcaaucgaaggucauaguuuccucaucccucgaagcugccaccuugcaacaucauccuuguguuacuuccaguuguuucuuaugauaaguaacagugacuuugauauauccauuuuuuaguuguguacaugguggugaugguguuuuacuccuugcuauaaacgcuuaaggauuccuuagcuuuagggaaugaaacuacuugggcaagaauauaaaauuuuguucuauuuuauuuuaaagcucugguuacauauggucaaguugcuucccaaaaagcgucucugucaggaugaucuuaugaacgacguuaguaccucaauuuuacugucccauccuuuuuuccuccuuccuugccuccuucccucucugccuccuuccuuuucuucccauuuccuuccuuccagcauuaucauauaagccacgugcugggauguaccaggcacacuagcucuauagguaagauauuuccuaggacucaucauucacaugaguccaggagaaauacaucuuuuguuuguuuguuuguuuuuugagacagagucuugcucaggcuggagugcgauggcaccaucugagcucacugcagccucaaccgccuggucucaaaugauccacccaaccuagccuccuaaguagcugggaccacaggugcaugccaccacgcccggcaauuuuuuuuuuuuuuuuuuuuuaaguagagacagggucuugcuguguugcccgggauggucuugaacuccugggcucaagcgauacucccuccuuauccucccaaagugcugggauuacagguauaaaccaccaacccagccucaggagaaauaaaucuuuuaggaaaaaaaagugacacaguuuucucuuguggcuuaucacuuggaauguggagagucauuuccauuagggaaccaccaggaaucuuggcaacuuagcagccacaggagaugcagaaacugaguagugauuuaaaaauucagaucacuuuguuuguuccccuagaauaauacauuauuaucauuaacaaaguaacucaacuuacaguaucaaaucaacugcagagccauugauauugauguuaccguacuauccaacacauuauguuuaguguugauuuaagaaaauguugauuuuauuugaugucaugggugggaaauugcuugcuuuuguuuuuugagugaaucugguuuaacugggcuguguaagccaaggaguucuaacucuucuugggcaacugagaccguggcuaauauuucauuaucuguauuaauuaaagacagggccugguacuugacauggcagugugauguguccaagguuagacccgagguaagaauuuagagcacagaggcacgcucacaugaagcugccaauuccucugcuuuuucagguagaggcugaaugauuuccgcaccuuuuuauagauugcaugacuucaaagaugcacacuaauacuacggcuccuugggaaaucuuucugcacugaucccuuugaaucuucaguguuucaacauagacuuguuacaaagagaaggaauauaagccucuguucuuucuuguuucccuuuguuaauuccuuuuuccuuucauuccuucuuaucuaucccuuucuuaccuucuuuauuuccucguuuauuugggcuuuuucgguugugaagaucaguaccuugaaauucagaauagauggcaugaagcacuucagcuuugcauucaaguacucauguguaugaucaagcaucgucaugaucauuauugacuggaaagccuguaagaagaagcggauaaggccagggugcagacugggcaguaguucccugucaugaauccacucugcaguuguuuuauaacaugcaacaaaaacuaaagucuaauagcacuccccaaugccaauuuuuuuucuuucucuuuuuuuuuuuuuuuuuugagagacagggucuugcuuuauagcccaagcuggagugcaguggugccuucacagcucuuugcagccuugaacucugggcucaauugauccuccugccucagccaucugaguaguugggacaacagguaugcacuaccaugcccagugaauuuaaaaaaacaaacaaacaaaacacuuuuuguagagaaagggucuugcuauguuggugaggcuagucucaaacucaugcccucaaaugauccuccugccguggucuccaaaagugcugggauuacaggugugagcccccaaccccaaaacuugaaucugggccaccuuuacugacuuacuuauuacuauguagaauaugguacaggugacgcugcagacucuugaaguuaggucauaaaagaugauccugcuuccgucugguugugucucucacucaugggaugcuuacccucaaaauuuggccaccaugccaugaggaaacucaaucuagcguagguaggaagaccgugagaggcccaaauagagaggaauugaggccgccagucauagucagcuucagucaucagauaggaagccaacaacugagcccucagaugauuccaguuuccaaacacugugaagcagaggcugacuguccccuuugugccauauucaaauugcugacccacagaauucaugaauagcgcaugugguagauuuacacuucaaagucuuuggguaauuugauaaagaugugguaacugggcuaugcucuaaucaauaaucuuagcuaagauuuaucagaaauuaaaacuguauacuuaacuaaccaccuagauaggugcaggcauauaugaauucaccgaaauuugacucaacucccuugguuaauuuaaauaaaauaaaaguaaauaaggggaaauugcauacuccuaucuggacuguuuucuuaugguuuuggaaucucuggcagguagaaguaauuauuucuguaacucuuaggcagggcuuaggaauuaucucccuuagguuugacuucuuucuuucuugagaauaagcgcuguguuucgcaagaguaaagaaguggcauuuauucuguugucacagcauuacugagcucgaguggauggcucuuuauuuccuucucgucuuuucuuuucuagucuuugucaggacccauuccuuuaccccucuuugcuuuuacgguuuucacauuuuaauaauguaaaaccauguuccccaaacuuccgccuuuuuugucccauuugcuccgcuguuacaucauuuguuuuuaauuacguucauauuuacuuauguuuuuaugcacagcuauuuauaaagaagauucuauaauacuaaaguaaauagaagagcaauaucauuugccauaaauacaaaggaucccugaaaauaaauauacugccagccugggcaacauagggagaucacuguuucuacaaaaaauaauaaauuagcugagugugauguugugugucuguagucucagcuucccagaaggucaaggcaggaggauugcuggagcccaggagguugaggcugcagugagcuacaaucauaccacugcacuccagccuaagcaacagagugagaccuugucucaaaaaauaacuggcugggcaugguggcucaugccuguaaucccagcacucugggaggacgaggugggcggaucacgaggucaggagaucgagaccagccuggccaacaugaugaaacccuaucucuacugaaaauacaaaaaaaaaaaaaauuagccggguaugguggugugugccuguaguuccagcuacucgguagccugaggcaggagaaugguuugaacuugggagguggagguugcagugagccgagaucaugccacugcacuccagccugggcgacagagugagaauccgucucaaaaaauaaguaaauaaaauaacuaacuaggcuaggcacagugggucaugccugccaucccagcacuuugggaguccaaggcaagaggaucacuugagcccaggauuucgagaccaaccuggacaacguacagagaccucaucucuacaaaaaauaaaacagcuaggcauagaggcacaccuguggucccagguaguugggaggcugaggcgggaggauccucugcacccagguagccgaggcuccagugagucaugaucaugccacugcacuguagccugggugauaaaguaagauccugucuggaaaaaaaaaaacacaaaaaacuaaauaagucguccauccguccaucuauucauacacacacguaaaaugaaaacuaaagcaaaagaguaguauuaaauucuaguuagagacuuaggauuuccagugacugaaauuggaauguuagguguuaaagacacacaucaaaaugagacucuugguuuuuuuuauaagugcaaggauugcaagauaccugaaaagggaguauuuuucccccacaugcaucucaggaggguagccucagauauaagcuuaggaguccugaauuuaucaucaauauuuauaucgcuguuuggccccuaacaccuucccuaugauagcccuaauuggaauauaguaaauguuuguugcaugaaucaaccuauuuaaccugugcguccuuaaaucuuacggucugcggguugacauuucuagugaagggagacauuucuuuaccuaccugggaccucagaccuuggaccucacugaacuugagagcagagcugguuuauguguaacugaaccugaugguuaguuuccuguuucaacuugauuaggucccagucacagggugcccacauguuuggucaaacaucacucuggggugucugugaguguguuucugggugaggugaacauuuaaaucagucaccugauuacagcagauuguucucaagugccugagcuucgucucaucagcugaaggucugaauagagcaaauagacugacccuacuucaaagagaacuccuucugccugaugacucagguggggacuucaguccuuuuuuuuuuuuuuuuuuuuuuuuuuuuuuuuuuuuuuuuuugagauagggucuggcucuguuggcuaggcuggagugcagugacgcaaucucagcucacuacaaccucagccucccagguucaagcgauucuccugccucagccuucccgaguagcugggauuacaggcacccaccaucaugcccagcuaacuuuuguguuguuaguagagacaggguuucaccauguuggccaggcuggucucgaacuccugaccucagaugauccaccugccuugacgucgcaaagugcugggauuacaggggugagccaccacgucuggccugacaucagucuuuuccugccuucagacuugaacugaagcaucagcauuucuuguguuuugaucuugcuggaguuggacugaaacuacacaucaguucuccuggcucuccaccuugccuauagcggaucuugagacuuuuucuuauuuuaucuaucuaucaauccauuggucaucagguucuccagagaaucagaaccaauaagagaugucauacacaccacacacaaacacacacacacacacacacacacacacacacuaauaugguucugauucucuggagaacccugacuaauacagaggcaagauccuguuuugacgugcuugaacucgaggacuuaugccgauguuaacucugaguguuccuguuuuauacucagccauacagaugcucagagcauaccugcacaagucaacuuuuugugucugcaggcaugggccugcccuguacaugaggagacagcagacaguuccucucccugcugcuggccucuucaucuucuccuggcgucaccacggccaccgugaugccuggcucaaguacuaguucuaugucaaugaugguaccaauggacucuaacuuuagaauguuguugacugaaggccccugcccccugccuugcuuuagguggaggaucuggucaaggcuuugugaaucaggggaugcuccacaccuuucugcucucugcaacagggccagggaucugagucccuucuugucuauccagaaaccguauacccaguguucucuuucucucaccuccgaauaggugggccuucccaauuuaccugugagaaaacuagugugccaccucaagcgauucuggccucuguugacugucugaacccuguguuuuguugaguggugcagacuagagaugaagacagggauucggcuucgcuugcuuuaucaagggaauguucuugggacaaaugugugacaggugaggaaaacaacauaggaaaggagacagaagugaagagaagauguggucucaaaugaagucuggcuucagguuuauccuuggggggcucuggaauaaaaaucacaccucaaacuugacccgcuugaggccagaaggccgggcugugguaccuucgugucggacagucauaggcuauccucauggggaccuguauguugccaggugucuugggcaagguggacaaggaugccagcaaagugaaauuuuccagagaaggucacaaaagcuaggaaauggcacagcagcugcuaaaaggggaucugaccaggccaccaacagcuucugcuucuucccaaagucaccuuugcucucuccugaccaccguuggugucucaaagucucacaugugacaacacacauaucaucaaauucaugaguauccauggcacacaauguuuuccuuuucuucucuucucuuucuuucuuguuuuguuuuguuguuuuauuuuguuuuguuuuacugagauaggaucugucucuuucccccaggcuacagugcaguugcgugauauuagcucacugcagccucaaacuucuaggcugaagugauccucccaccucaacguccugaguagggagggcacuacaggcgcaugccuccacaucugacuaauuacuaaauuuuuaaaaauuuuuuuagacacugagucucaccgucuugcccuggcuggucucaaacuccugggcucauacaauuccccugccucagaaucccaaagugcugggauuauaggcaugaggcaaugugcccggcccacaaugguuuucauauagcuauuguguauugcguuauugccuuagucacagaagcccauaaaaaacagauuccaauaaagagacuagguuugcagagugaugaguggggcccuugaaauaauuacauuuaguggguuauaugucuauuuuuuuggucguuccuugcucaucugucuuuauuuuuguuuauuuauuuauucauuuauuugagauggagucucacucugucacccaggcuggagugcagugguaugaucucggcucacuacagcuuccaccucccauguucaagcuauuuuccugccucagccuucugaguagcuggaauuacaagcgcccgccaccauacuucgcuaauuuuuguauguauauguguauauauauguauauaauauauauauuuuuuaguacagaugcgguuucaucauguugaucaggcuggucucgaacuucugaccucagaaugauccgccugccucagccucccaaagugcugggauuacaggugugagccacaaugcccagccuuauauauguauuuauuaaguuuggggggaacaggugguguuugguuacaugaauaaguucuuuagugaugauuucugagauuuugauguacccaucacccgggcaguguauacuguagccaauauguagucuuuuauuccucacccuacucccacccuucucccugaguucccaaaguccauuguaucauucuucugccuuugcauccucauaguuuagcucccagucuacaggguuauauuaaaagaggaaaagggguauaagaaucuagguaucauggaugauguccugguccuuugcugagucccauuuuuuucuuccucaccugauuucccccaucuggcagaaacuuuuacagaguguuugcagaagagaagccuguaaacucuggaguguguccugggugguuuguccuugggccacuuuauucccucaccgaucccuuccaaaggccaugaguucccagucagucauuucccuauaucaguauuuauuguuuuaaucaauuuuccccaucccaagagaaaggcaccaacaugaguccauguguuuuaacauagcagggguuucccugucagagcccgguggacuucuguggccauaagcaagucaaggugggcuccuaaguggcagcugcccacuuccagaaagcuagagguucuaauuaugucuuccugaaaaacaguucaauuagguaaagugacauuuuuuaagcccuuguguguguccgacucauaaaaguucagaagguuguuacugagaggagacugcagucauuuuaagauuucaguagcugcuggaguugaguagauaauuuuuccccuuucuaauauuauauauuaggugugcucuugugucugggugaaacagagcaaucacaaugauuguuuuuucaguaugguaauaauuaggcauaaaaucaauauuuauguguaaugugccauuugaagauucucccuguguaugaugcuggguuuuacaaaggaaaaucuggauucagguggccaaugaagugucacgauauaaaaagagaauuuugaaauaaugagaauuccacuccuuugggaguauuggcauauguuaaaauacaaauauaucuguauuuuucucacuuuuauuagaagagugcaaguuuguucaaaacaacugcuggauuaucuagucccugaacagccauuuauauuuuuguuacgcuugugguuuuuaaaucauccucauuuccuugaucgcauuugcuucuccuggcuagaauguguaggagacgggucggggagacugugcccauuugacaggugugaaugcgaacagaggcugcagcugguuagaccagggcugugcaacccuagagccauugccuugaccacaaagccacagucuccuaguccuaauauuaagagguaggagguagauagagauugucccuuaagccacauuccauucuucauauuuuuguacccauuagaguagugcugaucauuugccuucauugcugggguccccuaaaugcaacuucucaugcugccaauuuaguccuggcccuaggaagacguaggugauaggauagaauucaacaacuagaagccaugguuuccugguuggauagacuuccucugccaccagaauaaaggaauagaggguuccucacugugccccauagcugcaaagucacaggaagcuugcagcaggccagugguaaccucugagugacuucugaguucccagagcuaggaccaugacuuuuccccuggauucuuaaguacccggcuaaaauuguguuugccgaaugaaagugugauccuggaggccauguuguuugugguucauggaagggugcuuguucagcuuggucaaagcaagauggucauacuggguuuuggugcccagacguucccaacacucgcagcagagggcauuaggaucauguuuagccaacaauuuuggaggcacccaacagugauuggaugucaugugcuuucagaaggcacacuacacaucuucgguuccuccaagcucuaggaaaggguuguggaauuggguugggugacaacaggucgguaagaagagggcugggcugaguguaaagaaauuccuuggcugggcaugguggcucacgccuguaauccagcacuuugggaggcugaggcagauaaaucaccugagguuaggaguucaagaccagccuggcuaacacggauaaaccucgucucuacugaaaacacaaaaauuagcuuggcuuccuggugcaugccuguaaucccagcuacugcagaggcugaggcaggagaaucgcuugaacccaggaggcggagguugcagugagccgagaucguaccauugcacuccagccugggcaacagggagagauuccaucucaaaaaacaaacaaacaaacaaacaaaaaccccagauauuccuuauuauggaagaagaagcaggaaauauguuuuugaauaaucugggucagagaauugugcauuuauuauugcuaggaugcauauacacauugaacucagucaacuuacucucucuaaauuaucucaccgguggagacauugccucaggagucgagcccuguggugugccuccugcugucaccacauuugaccaccuaacugaccccacuguggucaccuuugccaccugcccugcuuuggucccuucucugcauucgccccaugccauguagcacugcugaguuugaaaauaauugcaucuccugaaaacuccauuucuuagagagugagcuccagcaccaucagccugaaguugaagaaaugggacucaggaaggcuggagucuucaggcguucuuacaaugcugaugcgacucagacggcugccugcacuguccucugugcuucuaagugaaauuacccgucggggggcuccugagaguuaaaucaagcagccucucuugaagcacaguaaaugcugacgugauuugugaagauggcucugcuaauaggguuggcagcguccuuuggcuuggaccuuuggaccccggcuggcugcggaagggagggaaggcagccuuggaaaacugauuuccguugcccucugaccaugagaagaucccuguuuaggagcuagaauucagaguuccacguguagagggggauuccacaguguguggugugcagagagcacucgucuuucaggcauggggcgccguuucauuucuccuagugcuggaaggggacuuggugaaauugauuuggcaaaaagguuaauguguuguuauggcugccaguuggccgauugaagcgcuaguaauuggggcaagggaagcauucaauuugacacaccaaaugcagguccacccugguggauaucuugguugcagcacucuguguguguacgugugugcaugagcgugucuuagagaugcuuuugcuccucuuauaacuccuaugauaaaaagaguugccauuaucauccuuugucuacucaccagcccccaccagaaacccucacagaaaaaauaagaguuuauuuuuucacuaugucacauuguuggagaacugugcaaauacaagcccuucucuuacaggccaugggucuccuaagugggauacaccacgaugauccacuggggcaguggccagcaaagucccuguccagccagccacucguuuuuaucaauaaauuuuuacugaaacacagucaugccuguuagguuaggaacugccuagcgccacuucacacugcaguaggagagugaguaguugugacagagaccauuuaucccacaaagccuagaaucuuuauuauaauccuguaacagaaagcauuuacugacuccuuagcauugccauguuuagcaaauaaaauugcaggaugcuggucaggcgcgguggcucacgccuguaaucccagcauuuugggaggccaaggugggcagauuacuugaggucaggagaucgagaucagccgggccaaccuggugagaucccaucucuacuaauaauacaaaaaauagcuggcgugguggcgcaugucuguaauuacaguuacucgggaggcugaggcaggagaaucacuugaaccugggaggcagagguugaagugacccaagaucaccacugcaccccagccugggcgacagagugagacugugucucaaaaacaaaauaucuggcugggcacaguggcucaugccuguaaucccagcacuuugggaggcugagguggguggaucacuugaggucaggaguucaagaccaggcuggccaacauggcaaaacccugucuauacuaaaaauacagaaaucaguggggcauggggcgggugcucuguagucucagcuacucaggaggcugaggcaggagaauugcuugaauccaggagacggagguugcagugaguugagacugugccacuacacuccagccugggcggcagagugagacgcugucucaaauaaauacauacauacaacauaaaguaagauguuaaaguaaauuuuaauuuuagauaaacaauggauaauuuuuuagcaaaaggauguuccacauuuaacuggacauuaucucugucucucucccuccuuaccugccuccuauccucucuucccacccccuacgaugucuauguauaguuucaaccuggcaacccugugaccucagcacuaggauauggauagaaaacauaguagccccuauuuaccuuuaucuuuuaucucaacccauuuaaaugucuuuuccuugcaauguuuuguaauauuacauguagauuguacaucguuugucgauaaaucaguguacaaauacuaggggugagugugcucaaaacuuauuuuuacugauaauaguccaugaucaaggcaguuuggagaccacucaggacagggaaaacgcagacucaugugacccaucagggcuucaggguguccucuggugaagggcagcagcaggacagagccccacuucuagcucuggcucagguuaaguguuucagcgcccuggcuucugugucuucaugugcaaauggagauaauagucagcaccuaugcagguuacugugaaaacagguuggaaguauuuaucuacagcguggaccagagccucugguauguacuaggugcccuagaaauguucuuuccucugacucaaaugacaaaucaguuucuagggaaaggaacgcacagcgauccccagcgcaucacgagaaaucucucuccagcuuugcccuggcugcgcuggugacucacucggggcuaaaacuguuuaugucugcggagucagagcguucugcccugcgguuucaguucacaugggguugggcgacacaguuuuguuuucacuuugguuuaucgugugaguuuccauccaucaacucuuuuguaucugauguucuugggaaacuuugcgggaauucacuugaaauuguccagugaacagccauugcgagucucauggucagagccgggggcuucccaguguagggucuggucaaggaaagggccacuuccugggccucccaaaaagaggaaggagaaggcccuggcuuguggaagaguaagaggggccucguuaaugucucccaagcacaguaccccaacuccccacauacagucccaacccuuacugcagccgggagguuaggugucugccgugcucaugaacaggaagugaacccgaucagcccccgaaggaaacauccgucucucuccuuggaggagacacuugagugucuuucucugugugcugcagccguuauugauaucaguucccaggcaagguucaugcuggcagaggaggccacucuuucugcacuggagagcaaaagccaucuuaucucucugagugcaaggugacagugaggagauuggcccuguguaucccucagagaccaguauucccucauuugccaaucuagaaagaagacuguguuugcugucauuuguuucuuaacucauugauucucaaacagaaucuucccagggaucugcuucaugcuguauuuuguacuguguccugagaugaugaggauucggugucuacccucaagaagcaucauuuagagaagaaauuagaaaaguaagugaggcaggagaacaggaucuggaggcagggaaucuaaggcugauucacguugacuuuguauaauuaaaucaaaaggaaaacaccaacuuuccacaacuaaguuauaaaaggaccagaggcuacucccucugcaaccccuccccacuuuucugaguugcagauggaaaauugaaaguaccccugauugguugcuuuccacgaccauucagccguuugcauaggagcuguaacuuuguaacuucgcuucacccucugauugguugcuuuucacaaccuaucagacauuugcauaggaguguaacuucuuuccacaaccaaucugacugauugugggccauuacuucauuuccaugagguguacaccaaguggccaaugggagaccucuauaggguauuuaaaccccagaaaauucuuuaaccaggcucuugagccucuaugcuugggcugcucccaccguuuggaguguacuuuccuuuucaguaaaucucuacuuuuguuguuucauucuuuccuugcuuuguuuaugcguuuuguccaauucuuuauucaaaacgccaagaaccuggacgcccuccuccaguaacauaaugaaugucuggaugugguaugaagaguauugggguacaccacagcagcgugugcucugagaacacaguaaacaggcauuugauacagaucagaagguccguaaaggugguauuugaacuaaguuuugagagcuggguaagaguuugugaaaagacagggcuuaaggaaggauauaguaagcugaaggcacaggacuuuagaaacacauaggcuauaacugcaaggugugucucagaagguacaugugacguuucauuuuuauuuguuugcuuuuuuauagugacugcaugaucauuauaugcagaagacgcuugaaggggccagauuaggaagggcccaugguccacacugcuuuuuuuuuuuuuuuuuuuuuuuuuuugaaacggaguaucugucucucacccaggcuggagugcaguggcacagucuuggcucauugcaacaucugccuccuggguucaagcaauuuucuugccucagccucccgaguagcugggauuacaggcaccugccaccacaccuggcuaauuuuuguauuuuuaguagagaugagguuucaccauguuggccaggcuagucuugaauucuugaccuuaagugauccaccugccucggccucccaaagugcugggauuacaggcgugagccacuguguauuucuauuaccagccugcacugcauuucuauuacccgaaaacaguguggaaaauauuaauuacaagggagauuaaaaaguaaaacugguugguuggccugaagacccacauggugacuucacuaaagucauuggguaagcaaagaagagcaacacucuaguuuuccuccaagcuucaacguuuucuguuuccuccuaugucaggucuuaauuucccuaccugauucaggcugcgcuaagcugacuucaucaugacuccuggcuuccccagucccugcuucccagcacauaccauuuauucaguguuggccagugacgccugccacugcauuuuauugaugaagaaauggagaucucaagagguaaaaaaaacugacuauaggagccaagacuaguuuagaguggaguuugaauaugaacaugccucugucugugaaagccagugucccuucagccaggaucuuuccuggaagaacucaguauuaaggcacuugauuaguucuuccuguugguggacugauugauuacauuugaaucuuucagcaagcuuuuggcugagcugggcaucuuccccgccuuccuccaccucugccuucaaaagccugaauuuccaaggcuuucugccaugaguacuuagcuuugaaaaacaugagcauauuuuucauucuucuugccggccucucccugugucaugccuguuauucuuuucucccucaacauugaccuaggucagaaggacccuauuuuaauguuuagcguuugggggucacuccauagagagggguuuguggaaauccuuuuuuuuuuuuuuuuuuuuuuugcuucuuucuguggaucuguuuggaaauguaacauuuuaaagcccuucuuggcuggaggauuuuuuaugguaaacauaaaacguucauugaaacauuaaacauuuuacagcuguuuuucagcacauaaauuuucauagacauccacccccucacugccacacccccucauagauuucuucuuuuccuccuccuucuccuccucccucuuccuccucuuuuuccccccccuucaaauaguuccaagaccagaguugaggguggguggguagagggcuaguuuacagauaaaaugguugguguagaucaucuaguuuggaaaaagcacauuguauuuuaauacuaggaacgugugcaugccagaaaccugccaaggaaaacacucccgcugcuccuuccagcccugacuccagcugcuaugaacuggaacccugcaccacgucucagaaggcuacugggaagggccauaaucuguauccauccacaaggagagguggaggggggcuacucuaagaagccaaaaugcucaggaaagccagagcuaagauggugcaaaccagcaugugauuuguccaaggacaucguuuugauaugaugaaccaugggugguuugggcauuugucaaagcagggucagcagaaagcugacguaguugggucuaaaguacaacaggacugagcaugguggcucacaccuguaauucuagugcauugggaggccaaggcaggaggauugcuugaggccagguguucaagaccagccuuggcaauauagcaagacauugccuguacaaaaaauuuaaaaauuagcugggaaugauggugcaugccuguagucucagcuacuugggaggcugaggcaggaggaucaacugagcccaggaguuuaaggcugcagugagccaugaucaugccacuacacuccaguacacuccaggacuuuaggccugcuaaagugcauuguaguaauacuagauaucagcacccuugccauggccucaugagcagugaaaugaacuuucuugcuccuggauuuuuggcucuuggccuuguaauuuuuuuuuuucaugggauauuagucaacaugaugugagcagagucuugagaugugcuugcaugauuggcuuuguacuccugcauuuuucccauagccaaugccuuuucuucagcuugggcugcagaaugagauagaugaaacagaccugaaucugacuuauacccuggagccauuuucagcaaacccagucaauaucaggccaaccucaaccaauucuuagacuagugagugaggaaaauaaauauuugaucuugugaacccuugaaauuuugagguuguuuguuaugcggcaguauuuuggcaguagcugaugaauacaccacuccccaucccuaguggcuuccuauaccauuuagaauaaaaauacacgcucuuuuccagggucuacauguccugaagaccugaacuccugccugccucucaguuuauuuccuaccucaaguagcugugcccaauguccucccaauauccugcaaccacucuagucuucuuucuuuuccugggacccacagagccuauaucugcuucaaggcuuuuguacauguuguuucuuuugccugggaagagugguggggggcacuuucuugcccauuuuuuuuuuuuuuuuuugagauggagucucgcucuugucaugcaggcuggagugcaguagcacgaucucggcucauugcaaccucugccucccggguucaagcaauucucuagccucagccucccaaauugcugagaguacaggcaucugcgaccacaccugucuaauuucuuaucuuucuaacacaguuuaaauaucacuuucucagaggccuacccugaccauccuacuuaaguaacaauaauaaaauaaaaauacccaucauuuaugaagugcucauuaugugccagcguucuuagcaucucccaacaacccuaggagacaggcauuacaaugagccuucguaauguucagaugaggaaacugaggcuaagagagccuuggcaagcugaguuacuuagcuagcaaaugguggagucgaauucaaacccugccucuccucacccacucuguuucuuuucuuuugagcacuuaccacuuucugaauauguauacaauuguuuccucgauuacugucugccucuucuucccuagagcgucagcccaugagcuuauccagccuacagaggagaugcugcagcuuggcagagcauggauugcucaacauaccagaguuuaguccuaccucugucuccaagcugcuccaugaucaaggauaaacuauaaucuuucucucugccucaguuuuuccaccugucaguggaggggcaugcucuuggaugccugaguuuuucuuagacucagcauccugcagccgaaauaaccaugcuucuuagugguccucuugcguagcagccuaagaaacuccaaguccaucugcgccgaagaguauugaacuuggccagagcacuugggaucugcagaaguguccccugucuguuaguuuuuucacagacucugcucuuucucucccagaccggacccuccacuccucuaucucgcauuuauccauugcaccccgugucauugccgaauuccugagcuacaaaggugaacaggcaccaaagcuagggcaguguccacucaauacauaucugaugaaugaaugaaugaaccuugucuaccacagauagcucaccacaaauaaacauuuuaaucuacuauaaaauagcucaaaagacucuaugcaaauaauuacuguuacccagugguggaagugcuucacuuuuuauggaaagucuuucacucauuucuaucugcaguauuuacugggcauuuuuccacgccaagcccuggggauacagaguuaaauaaaauagaagcuuaauccaggcaugcuggcuguaaaguucaccuuucggcuccuuucugccauucuuauuagggucuugccccaucuuggcagcaagccugcuuuaccauuggagaccucagcucugauuacaauacguccgugaucaacaugcccuaacugguuagcagauggcagcugcaugaagucacugggcccagauaggaaucaacaagggagauuagguaaagugcuuauuugaggugcugucagggcccguggcaaaggguucccucauucccucugcaguuauuuuucaugcacacucggauuacacugcucggugauauuacaucugcaugcgucuugcccucugacacggcaaacacagaugcugcccaaauccuuguaaagccauauaucuuaaguaggaaggagcaucuuugcaggggaggugaauugauuugcaaagcagccugacacauggucucuuauuucuccuugcaaucaaauaauucaucuuuaugcccguagggccguggugaaauuugaaccugaccaaaucaacgacugcaagguuuauuuguagcagugggaucagagaaauuagccaaguguauucuaaaauuaucaauugcugaucacauggucuggauguguuuuagugcuuagggguugguggaccgaggcuaugguggcauaguccuccaugaccaagggcugucugcauggguacgcagauaaaacaugcacugccauggggugaccugugugccaugcaucacacacagacuacuguuuaaccaccuacaucauagguagauccugcauuuuacaaaugaggaaacagagcucgagagaaguucaauccucuucccuacagagaggaaaggggaaaaaaauggacuuucaagacagcugaaauucaaaacaaaacaauguuuuaaaauugaauacagccuuuugcauuaaaauuaccauuuuaauaauaguuuaaaagagagaaagagagagacccaaaauagucaaacugagguuuuggguucuggugauagaauauuaaaucauaaugaagcauuuaauguuuuguuguuguuacaauuguuguuuuacccuagggcuaugcaaaguaguuuaaggauguauuuauuucaguggggaaaaaaaguggaggauauacauuuggaggauaaggaagcaugaauuaggguggaggaaguguuuucuggucuagcuaaggaggaaaaauuauagaccucaaaauaggugucauuuaauauauaucugugaaaaugggccaaauagauugccuccguuaaagccguauuggauguucaaaucucgaguuaccugaaaugcaacuguacuuccuauauuuaaccaggcuuuuuauaaacuguuccucuuaacaccucaagcugacaaccacauccugggugguuauuuaauaccaaguuugacuuucuucacuuugaggguccucaaaauagaaggucagagaguagacuuuuaaaagucuugcacuguuuacaagucagaugcuuuuuggcagagugacucucagcuccccccaacaaucccuucuugucguucaguaguagauagacucuaucagggaaaaauaggagaaauaaaauaagacagcauauggaaggcauugcugaaagucuuuuucacaccuuaaaaacaaggaagaagagaaaugaaaauaaaauagugagcaacaccucggugaaaguagagguguuuguacaguucagcugcugccuuauucaaaaacaggaagaaaaacccacugcccaggucagcuggugggugaucuccacugaacuccuauucagaggcucaguuucucugcaggacagaaaugagaggcacaaaauuucauagcugucuugccccuccuguggucuguaagaaugggaccaggacuccuaguugugaacccgaaaggauuuccauuaggaucaggaagugugaguuggcuuagaaaaaguaaagaaagaacagugcuguuucauuuauuuaucauguguaaguaaacugggauuuauuuuauuuuauuuuuuauuuuuuguuucaguuucgggggguacauguguaggucuguuacauggauaucuugcaagauacugagauuugggcuucaauugaacccaucacccaaauuaguaaacauaguacucaauagguaguuuuucaauccuuuucuccuucccucccuaguccccccuuuugaaguccccagagucuauuguuccugucuucaugcccauguguacgcaguguugagcuucgacuuguaaguaagaacaugcgguauuugguuuucuguuucugcauuuauucgcucaggauaauggcuucaagcuguauccacguugcugcaaagaacaugauuuucuucuuuuuuauggcuguguaguauuucgugguguauacguaccacauuuucuuuaacuaauccaccauugaugggcacuuaggaugauuccaugucuuugcuguuguggguagugcugccaagaacgugagugcaggugucuuuuuaguagagugauuuauuuuccuuugaauguauacccacuaauaagauugcuaggucaaaugguaauucuauuuuuagaccuuugagaaaucuccaauuuauuuuucauagggacaagguugcagagaaaagagaagagugcuguuucaaacaguugaaaccauuccuacuuccaaaaagaauuugacucaaaagggaauaguacacuacauauaaaagacagauguauuuaauuuguguuucgaacuacauaucagaaauuaguuagaagaagauaugagauaaauauaccuggaaacuuuaugaauuauuucugacaucuagcauuaaauuuagcuggguuuccugggagucaaaagcaaagaguuuucaaccaaaaaaaagaaacagagguguauaguaacacaccucuguccugcaacauaacuguaagaauuuaucagauuauauauauauauauuuaucagauuauauauauauuuaucagauuuuauauauauauauauauauauauauaugcauauguuuguauauaaauauacauguaaagacccaaaacucauauaaaaagacaaggugauacagcauuuuaaaacaguuuacuaaaaauaacaaaacauucuuccaucagucaugcaugccuuauauuuauguagauacaaaaauagaguuugauauuaaacaauacuccaagaaagccauuucugcagaguuaaaaaauacguagguucaguuccuuaccaacacguagacauguugugaugaaagaaggaaaggaaggaaggaaggaggaagggaagaaggagggagggagggaaagagagagagagaaaaggaagagaaaggauuuucuagaaaaagaaaggaaggagggagggaagguaagaaagaaauuaauucccauuuuagaguaagacuggaggcagaguggucacccagaugaaaaugaauaacccaacugugucuuucuucuggugccuccacguggaagugggcugccacaauacuucuaaagagaauuggcauuuuucuuuaaauaaggaggaggaugaggagagagacgacacaaaauucacucacagaagugaacauaaauucuaacauugguaaaacuuugucuuuguuuuaaauaaucagucaguugucucaauccauaaaagaguaucucuuguacaaugucugcuuuugagugauucacuucgaugcguacugaaaauauaccuuuaaguaguugagugacuugaaauauugguaaauguucuuuaauauuuugucugucaguguuagagacuaucagguuaaaacaaagauauucuuucuuuccuuuuuguuuuugacggagucucacacucuguugcccaggcuagaguacagugaugcgaucucagcuuacugcaaccucugccuccuggguucaagcgauucuucugccucagccuucugaguagcugggauuacaggcacacaccaccacaccuggcuaauuuuuguauuuuuaguagacacgggauuucgcccuguuggccaggcuaguuucuaacuccugaccucaggcuucccaaagugcugagauuacaggugugagccaccaugccuggccaagaauauucuuucuaauaugauuuagcuaacagguucagcagauuuuuaaacucacuuucaaaucaugauaaaauucuuuaagauaaacauuugucuucuguuuuccccugagagugguuuagcauuuauggagcccugcuuugugcuaaugaguuuauaugcccugucuucuuuaaucuucaccacaacuuuauguaauaaguagucuccaauaaauuuaaucacauaauuacuuaaauggccuggcgagccgccuuaccuagcuggccaggaauuccaggagucaggcuuccugaucuaaaucuguccuggucccaucuuggcugggugccaccagcagcaacggcacacuccagcuuaaauaucaguggggauaauucuaggccguuugucugccugguucuuccaggauagaggcagugauuucaguaaucucuuagggcugggcacgguagcucacgccuauaaucccagcacuuugggaggccgaggcggguggaucaccugaggucaggagauggagaccauccuggcuaacauggugaaaccccgucucuacuaauaauacaaaaacaaaauuagccgggcgugggggcaggcgccuguaaucccagcuacucuggaggcugagacaggauaauggugugaauccgggaggcggagcuugcagugagccgagauuacaccacuacccuccagccugggcgacagacuccagccugagcgacagagugagacuccgucucaaaaaaaaagaaaaaagaaagaaagaaccucuuaggcaacucucauuucauuauccagguacaaagacaaugaguaagaagaguauugggguugggaggaccagucaccccugugucuuaagauacuucucaguuuucuuuguugcagcaaauauuacugcagaguuuuagugcauuauagccuucuuaaauaaaacuugcccaggugcaguggcucaugccuguaaucccaucacauugggaggccaaggcagguaguuugcuugagcccaggaguuugcgaccagccuggcuaacaucaugaaaucccaucucuacaaaacauaaacagaaauuagcugggcauugugguauguaccuguagucccagguacucaggaggcugaggugggaggauugcuugagccugggaagucaaggcuguagugagcaaagaucacaccacugcagucaagccugggugacagggcaagacccuauaucaaaaaaaaaaaaaaaaaaaaaaaaauauauauauauauauauauauauauauauguauauguauauguauauauaaauuuaaggaagcauagaauugaagaggcuauuccaaggucacaugacuuuuaaguggcagaaacaggggaauucugucuaacacaauccaauuuauccaucucaagaaaagagauaugccaaagagaaugauuauuaaauuaucauuaaugugaacucuuguaauuacucucauaauuuucuuuaggcuuaucccauugggcauugcuaaguauuauuagauugugauuauaaauggauuccgccaggcauuucucuuuugcucuguggcagcucuuucucuagagaacuuggucccuggggaugccaucuucucugucuucacucggugaggauggacuuuaggaugccucacuucucuuccugagauucuugcuuccuucuuccuuaagggccacugaugagcaaucagugaguuucaggaagaaggcauucaggcugauuucagacagccuaaggucagugugcaaguuaguauguaccugugucuuauuauugaacuggugaaugaaugaaugacuaggucauuaugaauuuguagaucaggguuuugaagaguuuggcaccggauuugaaagccaauguucucuuaguaccuaccgcuuucuuuuccucaccuuccuggauuuccugcucuuaagguuuuuuguuuuuguuuuucucuccaaauaaaugguauuuauuaaauaaaaauucauuuucucauuuaucaaccaguugcagucuuuggauguuuuaauuauauaaaaaaagcauggaaacugggcauuuuaauuagcaaguacagccuugacacaaauaaaggcauggcuuugguuaugcagugcauuuauuugguuuucuugaaauaagaaaaaaagauuucuucuccaucaccagaguugcugaguuugacagugugaaugagaugaccucuaaggccucuacuuauagaucugcacgguugggccugggagcuguacuaccucagcuggugggugauaacuuacucacagucugugcuguguccugcacuguccauuaucugcaggggugguacugcuguccccagggaagagaaugcuguccacaaagagccagccauuuauacuauuaaaagaauacacaggaguugaacaaugagaacacguggacaacgggaggggggaacaucacacaccggggccugucuggggguagggggaaaggggagggagagcauuaggacacauaucuaaugcaugcggggcuuaaaaccuagaugacggguugauaggugcagcaaaccaccauggcacauguacaccuauguaacaaggcugcauguucugcacauguaucccagaacuuaaagugaaaggaaaaaaaaaaguuucaucaaaaaaaaaaaaagaaaaagaaaacaccggaaaaaagagacucucuuccuugaaggauuuaauuccaggaauuggagaaugucuuguacauuucgagaaggcaauauagaaaaugcaguggguagcccaggacuccugguccagguaaagcaggccuuguugcuauuccccuggaccaugauauuacauguugggaugauggggucuugugauacugauuaauuuaaggcugcaugaugaugagggaggaacaaagauguucuugagucaguaccugccagaguggcuguauccugguguuguaauaucaaauaauucuacauuauuuaguaaauagcccugcccgaagccucucagugccacacacccacugggauuccugugugauuugucaccuggaggaacaucaccugccuugguuggggagaggaagccucaggacccugcaccagggccaugugacaaauacccauuuugauaguucaguacccgcuauuaaauaugccgaauauuauuccugaaaaggggcauggggauaauuacaaaaacauaccugguuccacucucacuuucgccauuuaauagcuuugggucuacaaguaaccaccccagauuuuucuccuccucuaugcaccagucauaucaagaauuacuguaacuucauaggauuuuugucaggacgcuaugaugagaagaacauaugccaaggagacaguuuucuggcaaaucagaggccuguaagaaaugauggcuuuuugcuuguaugaccaagucucuuggagacaaggccucauguaugaacucugaggcaugagaaggcucagaauucaccccaucuucagucuuuuauuugaaaaagggaagaaugauggaaaggggaggagagaguauauaaaacacgaacggggauccuagagacuugaauuucuaguauguacugccucuggcuaauagggaucuuugacacauacgcuuuuucucccuuuccagcuggcccuguugcuuaaaguggcagaaguagaugucauguuggcagacaguuuuguucacugucaaaacuggguuuaucuaauguguauuugaaacaaacaaaaaaaaaucaauaaaaugagcagcuuugggagccagggugaaggcgguugagauaggacagaacuccagaggacucuuaaacauuauucaggaagcucugaagcucccucagucugggauuccagaaaaagauugauuaggcaauaguuuaccuuagaccaugaggagauggacuuuagccagaacacacugaaaaacacgagaaaaguuggaagaaggaauuauuuuuaguguucugagaaugcuuuauugauauuccuaugagaguuucauugguuacugacgcuguguacugauuggguaaauucuagcauuuuuacacuccuuuguuucacccuguuuguucauucauucuuccguuaaacuaccauuaagcaacuaccauaucuaauuuuaaggugguggacaaagaaucaaaccuaaguuggggaauguggccucuggugauucucaguucuugguagccaugucucagcauagucuucucggacaccuaauacuacugaccuguauaaucgauaggguauugcagacaucagagcaugugacuuacgaggcuagaccauaaaaauauugaggcuucugccuuacugauguggaucauucacucuaggaaaagccagcugccauguugggaggauacucaagcauacccguguagaagaacugagccuccugccaacagccaugugagugaaccacguucgaaguugauucugcagcccuaguuaagccuugaggugauugcagccuuugcugcaaucuugacuggaacuuuauuugagccccuaucuagaaccaccgagcuaagcugcucacaaguuucugcaccacagaaauucuugugcgagauaauaaaaguuaauuauuguuucagcccacuuaguuuugggauaauuuguuauacaacaguggauaacugcccauucaaagagucuaaaccauuaacuguucagcauuagguaagaaaaccaguuaauuguuacuuucuuaccaccuaccccagcaccccagcaccccagcaccccagcaugaccaccauuuagagggagcugcgcuuuugcaaagguacauaggacacugucuguugcuucuguaccucuugccucaucaguuaguggugugauguguuugccugacaaauaccaucuaggacccuggcugcaugagcuuguugagacagcuaaauuuuacagguaguugggguuucaccauuuaacccaguuaacucuucuauaagugccguauuaaagcaggugguguauuuugaaagacguauguaaaaacauuuguauuuauuuauaugaaugaauacauuuuauuuauuuauauaaauacauuauauuuauucacauaaacacauuuuauuuauauaaauaaauccauuuuuauuuauuuauauaaguaaauaaauuuuccuauaaauaaucuuucugauugacagauagcgaccuuccugcuauguccuuacaugacagaggaagagaucaucuuucuucagccucuucugacaaguccaccagucucauucaugaggguuccacucucaugacugaaguaccuccuaaaggcucccccuccuaauaauaucaccuuggagauuaggguuuccaaauaugaguuuggggggacacauugauuccacaacacugaccuucuaucagaucagccaggaugcucuuuuucaaacuucugucaaucuuuccccaccuucacaaugugccccuauuauuauuaauauuuaaaauauugaagaucuaauuaauguugaaauuuuucuuuaaaucaauucauagauucauuaacuuuguuuuaaaaggaaauguucuauuuccaucguaaagggaagaucaauaugauuugccacauauagaugaagauaaaccuauauacaaagaaaauagaacuauaguaauuccauguagcuauuauuaccagagaauacucuaagcccaaugcuuguguucucuuugggcaaauggaagaugagccacuuguagagagguauuaaaaaccaaagcaagaucuuuugcaaguagauuaauugggcaagacaaagggaauaauaacuaugucaccaaaauuauuuaaugcaggguccaggagccaccuuaaucauccauaaauugguuaggcauguuuauuaccacagauuggaagcaggcuucccccaaguguguuucccuuuguaaugccagugucguaacgccacuaucuauacuuuucaacacaauuccaagugcuaccucugcauggcagaaacuaucaaccguggaugguuucuuuuuagcuuguccuucccguucuacagcauggagguuaagagcucuggcuuugguuccaaucguguccccuuuccucccuguguguuauugauugaccucucugagcccauugauaaauggaguuaaaaauuuauacucacugggguggugagaagguuaagggcaaugauguauacaagacauuagcauuugcuauaaggaggauguaucucaguugccauauuuguaucacuaaccauuugaagauuuuguguucaagauuuggaagagaaucuucuucccaagccagcauuuuauauuuugcauuaaaaaaaaccacaaaagacaaaaaaaaaaaaaacaaaaaaccuucacagacaaaacccagggcauauuuuagguguguuuaauucgaagcuccugaugucuagcaggaaccuggaacuucccuuucuauuuuugugggucaauauauucccacuuuugauuuaagguaguacaaguuguauaugggugccaguuagggauuccuggcugaucugugcaauuuuuucagugaaguuauauguggugcuuaguggugacuaugggaagauuacacggagaaguguuagaacaggguaaucaacugggaacccauuucaggugaaugccaagauguuuugaaggugggcauggcagggaaauaacaggaugccaugcuuggugagaaaugaauucguaagugugcacugucugccauaaagagccaggcaaggcacagaaaauauucuucuguuucuuuuucuauucuacccucucucugcuuuuucuucucucacugcugcugaagcagugagagccuguugaguuaaaauaagccagugaggauuuuggugguguuugcccuugaagccucuugacauacagugucaucaaggagcagugggugagccugcccauaucucgggcacaaaccuagguacucauugaauccuuuaaacuaacccucuaaagaauucucaaucuguggaugagaaauggcaacacagggauguuaaacugcaugccuacaaucauccauuuggaagaagcagggcuggaauuugaacaugagacuguaugcucccuguuguaguuuccuauggcugcuguaaaaaguuagcacaaaugcagaggcuuaagacagcacaaaugucuuaucuuacaguucugaagguuucgcuccagagugaguuuuauggagugaaaaucaaaauguuggcaggccuuaggggagaguccauuccuuucaucuuccagucucuagaggcugcuggcauuuuucagcucacggccacagcacucuaaucucugcuuucacuaucccuucuuuuuucugugacucugaccuucuugcuucccucuuacaaugacccuuuuaauugcauuaggcccaccaggcucauccaggauguauuugucuguguucacacuagugauaaagacauacccaaaacuggguaauuuaucaacaaaaagagauuugauggacucacaguuccauguggcuagggugggugcacagucauggcggaaggcaaaaggcacaucucacacggcagcagacgagagagagugacagccaggugaaggaguuucccguuauaaaaacauuagaucucaugagacuuauucacuaccaugagaacaauaugggagaaaucgauccugugauucaauuaucucccaccagggucccucccacaacaugugggaauuaugggagcuacaauucaauaugagauuuggauggggacacagccaaaccauaucacaggauaguuccccauaucaagguccuuaacuuaaucacacuugcauuugauuuuaucaugcaagguagcauacucacaggugggauuaggacuuagacaccuucagcaagaaacauuacucagcccaacacacuccucaaaccuaagcuuauucccaaucacacagucaggagaggaugcccacaaugcacuugggguuuugugucugugucuccccuccaagaacagguacuugcccuugucuuuggagcucacagccaaguccuacagucagcaucagacggcuugucucaagcugcugauuuccgggagcaaagcugcugugggacaugagacucuuugaggcagaauaccucucaugccuggagagcauuacaggcugcauuagucuguuuucacucugcugauaaagacauacccaagacugugcaauuuacaaaagaaagagguuuaaugaacucacauuuccccaugucuggggaggccucacaaucauaauggaaggggaaaggcgcaucucacgugguggcagagaacagaagagagcuugugcagggaaacuccgcuuuauaauaccaucagaucucaugagacuuauucacuaucaugagcauagcacaggaaagacccucccccaugauucaguuaucuccuaccaggccccuccuacaacacguaagaauuaugggagcuacaauucaagaugcgauuuggguggggacagagccaaaccauauuacaggcuaaugacugagcgggggcuguuucuuguuguguucuuauaagaacuauugcauuuucuuuuucuuccaaauauaguuaauggccucaucuuuucuggacuagguuuguaguagaccauaagcaaaagaguucagaaagcacggccuccaagaagucggaucugcuugucuuuaucaaucuguuuggauuuuccuggcccauuuacucacaaauuuaaaagacaugaugaguuuucagggagaacucuuuagcauuuacauuuuaauuuaguuuuguuuaccuguuuagugcccucucgguucccagaccaucaaacucaccauugucaccggggagaaauuuguguuggcugaaaucuguagugguuggucugcugcuuuucuuucucugcucaucuacccugauaguuucccugugguuuguggugggcucacagcucuugaccucaggacucucgcuggucuagaggagauugguuugugggggcgucugacauguuuggguucuuugugacaucugggccacccgguugagucugacaagaaacacuuaauaccuccuuggcuuugaagcucuccuuuguggcacuacaagguccucuuugaaaucccacauucuuuuuuggauuuagguauuaaccccuuggugugaggagaaagauaauugucaacacacuuaggagagaaaucaugcaguaaagcugacccgacauagacuaacuuaaaacuaacuaguucauuagugcuaacuuaguucauuagugcuuuaucuccuugugugugugagugugugaggggaucaauuauauacauaagacaaagaccaccuaggaaauguuugagaaacugugcagugaggaugaaucaacaaguaaauaucaugagaauuucuuagauugaagaaauauuacuccuauuuggugucaacucugugcuggccuuuucacugaaguucucugauguaacugcccacaguaauccuguaagguauggcuaaucauuuccauuuuauagauuaggaaaccaaggucaaaaguggugaauugauuugaccaaaaucacagacccaggaauuuccucagccaagagcauacagcagcugugucuuaagacugugcccuuucauccacccucuugguacucaaagcuugguccaugaaccagcagcuucagcaucugcugagagcuugcuggagguacagaaucucaggccugacugaccccaggccugcugagucugaauuuuaaccagagucucuuggugacucguguguacuuuagaaggggaacugcucaccgcccccacuucccacugagucgaauagacauuaagugagccuuccuuaugugcucagccuguggugaggcugcaaagacaauacgacccagccccuguaaugcaaaauucagagcauagggcagcacacugcugccaugagucgaggugacacaguacuaacagugggcacagggggcucggggcacagaggaggggugcuucccagggagacugcccguuggagcuuacuccuaagcuaauugggaggcaggaauccacuguggcugagaacagcagcucugaauuugcacugucugguuucaaguccaaauucuacuacaucccagcuguguauuguggggcaaguuacuuaaccucucuggccucaguaucuguaucuguaauauggggaaucauaaaagcaccuacuuguuaaggcauauuaaaugcaacgcuacuuugaaggacucaugguaguuaacacccaguuugguaaguguuauuauugaaggcugagaacagaacgacaaacaacaaucacaacaaaaggcuggggaagauuuuccugguggggggaccagaugagcaauagaucuccauaugcagagggguaacugaguacgacucugggacuuacacuagaacauucauauugcaauaaagcagauuuuuccugagcaccuacucugugccaaagcacuauuguaggcuguggagauagggagcugaaguacugaaagcguuacagucaagggccagaaaaccauuguucaagcaguuggcguauggcuugaucuguguuuauuacaaagcgauacuuuuccuucuaaguacugcuuuaccugcauccugcaaauuuugguauguuguauuuucauucucauuaauucaaaauauguuccaauuucccaugugauuucuucuucgacccucacauguuuauuacagcauuuacuuguuucuguucauccagaacucauugaauaccugcuaucuaccaggcaguggccuggucacaucuucugaccucaaguaguuuauaguccaaaaagacauuggcucuuugggauagaggcacuuuuugggggagagaaacaugaaugcaauuuuuuacauagaguaugaaacucuguuccaaaucucucaaacucagguucuuugauucuuaagguauuuuucacugccgaguugcugucauugaaacaaaaucuguccuggucaccacuguaugcccagcaccuaguacagugcccugaacauauuagguacucauuaaauacuuguuccacgaaguuguuauuugguauucacgaguuuugucucaauuccuuuugauucuucuuuucacccaucucauguugacuuaauuucuccagcauucaguuaagaccuagccgaagcauaauugucagcauaguagagcuggcucuccucuuucuaauugcccugcagaguuuuuggggagucuguaugcaauuguguacaccccaaugccccaaaacccucuucuauuuccuuuagcacucuugagcugaagaagccccacucucccucugccccacaucuauugugggcugggauacauguugggccucugcccagaucaugcuuggaguggcaccagcugcguaggauaugugaaauauuugcucagagagauccagaaggguugaugugaguaggaucagcuggugcuccaggauaaaaaucgugucaccacuuuugccgaaaagucacuguguuucuccuguacucagcagguuacagggugccauauuguucucagucuuccggcucuacccuguuuugaagugcggccggguguuguuaaacggcuccgccuuccugccagaauuucuccguggggaggagcugccacccaguccagugaguauggccuuuuggucagcauugcagaaccuggcaaguccuaauucccugugagcuugacacaggaggccgccuccuccuccaggcccacuuggaggcauucuguccucuuguuggaagggaaauugguaugguagggaggugcuucuucugggaguggguuuguaaaauuaagacuguuuucauccaaaccaguuaccuguuugucuagaaccuguguucucugcuuucugccucuuguguugacauuucuccuuuggccuucaucuguuacucgcucacaugugccgugccccggguggguuuggaagccaugcugcuaugguuugauuccuggcuuuccaacauuaccuuugauaaccaagacaaguggcagucuaagccucaguuuccucaucugcaaaaugggugcaauucuaguaccuccuuccuaaggcugugaggauucaaugagguacugcuugcaaaguuucuagcacagugucuugaacacgguaaacaacuuaccuaggucugaucucauuugauauuguugcucauagcaaagguuuguugaguuuacuauggauauaacacuuguucuuuuuuaaaauaacuuuuaaaaacgcaaguguugaauuaucugcauugugccuuuagggcauacacaucugcuuacaauauuuuuugagcuuucagaaaacuuaagauaugguugagggaugcaggaaggaacaggacaagaacccagaucccugcccaacaggacaguggaagggaagucucagcaucucgaaaugagugccuggagaggauggguggcggcugugcggggaugugguagggugaugguccuugaaggaugcugcagaucacaguggccccacaguguggggauuggggugggauaugugacaacaaaggcaucccuggcagaggauccagcacgagcaaaggcagaaaguccaggaagugucaggaaugagaagagcccaguagaggaugggcuuagggacagugaugagaccuucugguagaggcguugaacacuagggugagggcuuugcucugacuucaggaagcaggugagaggcccugaaauuuccacguaagauucggggccgggcacgguggcucauacuuauaaucccagcacuuugggaggcugaggcggguggaccaccugaggucaggaguucgagaccagccuggccaacauggugaaaccccaucucuacuaaaaguacaaaaauuagccaggugugauagcgggcgccuguaauccuggcuacucgggaggcugaggugggagaauugcuugaacccgggaggcagacguugcagugagccgagauugugccacugcacugcagcuugggaaacagagugagacucugucuaaaaaaaaagaagaguuggaucacagcaaaggugagcuuuaaugaguucacucuggcaguugugccgaggagggacuggcauggagagaaaacagaggcaaaaaucacaaccucugucagagaacucaucgcacuauuucuguccugcccugggaugguggagccuaagggaacagagaggacagaguggguggcacaggcauugcggaggcagaaauuuacguggcuuccaugcccauuggugugaggagugaggggugaucagggaucccaguggcuugaaaguauaacaaaaguaugacuagauccaggaaauacagcuggagagacccaagucugcacagaaaagguuuacagagcccaggcacacagaugacaugagcaguuccaaaggagugggacggggugaaugauuuguggucagagguguggucacacauaccguccccugauagucggugggaacugggucagguuccauuugccaggggcaggacauacugcgugccuuggccuuuucugggcuacucaaaaaaggauuccaccagguaaacuugaaucaccuagcgcugguagaaagccuugcucuucgucaucucuccugugugucgcuagccuuauuaaaaugugcagaggagaccgggcaugguagcacacuuguaaucucagcacuuggagaggcugaggugggagaauugcuugaggcuauggcuucaaaaccagccugggcaacacagcaagaccccacgucuuaaaaaaauuuagccggcugucgugucuccuccguguagucccagcuauucaggcagcugaggcaggagggcugcuugagcucaggagguggaggcugaagugagcugugauugugcuguugcacuccagccugggcgacagagggagagcuugucuccuugucucuaaaaaagaaaaacaugcucagaggccuugugaguuagcucucuccaaaguuuuuaagacaaggaauucaguuaaucaaguuuguuagacuuguuugaaaaaagggccugaacaggcucagagcaagggcagaucaagcucuuccacagauuuuaauguucagguuuugugaccuuuacuuuuuuuauuuuggcaaaauguacacaacuuaguauuuaucauuuuaauuuauaaguguaaaauucauagucauuaaauauauucacaauguuguguaaccaucagcauuaccuauaccuaaaauauuuucaucacaucuuuuaaaaaauaacugccccuuccucacuuccccaagcuuguggucucugguaaccccuacuuuacuuucugcaucuaugaaauuguuuucaaggucaauccauauuguagcauauaucaaaauuucuuucuuucuuccucuccuucccucccucccucccucccuccuucucucucuccuuuccucccuuccuuccuuccuucuuuccuuccuuccuuccauuuuugacagggucucacucuguugcccaggcuggggugcaguggcacaaucaaagcucacugcagccuugacuuccugggcuucagugauccucccaccucagccucccaaggagcuagaggugcaugccaccaugccuggcuuuuuaaauuuauuuuuauuauuauuuuuuuauuuuuaguagagacagauuuugccguguugcccuggcugaucuugaacuccugugcuccggucauccacccgccugggcuucccaaagcgcugagaugacugcgccaccacaccugccacaaaauuucuuuguuauggcugaauaauguuucugugugagugugugugugucuguguguguguguguguguguguguguuugaauaauacuccuaugaacauuguaccaauaucuauucagaucucugcuuucgauucuucugcauguauaccuaggagugaaauugcugcgucguuucguaucugugugcuuaaccuuuugagaaacugccaaacugucuucaacagcagccgcaucauuuuacauucccaccagcagugcaucaggauucuaguugcuccacaucuacccaauacuuauuuuacuuaaaaaaauagaauagccaucugagugaaguguuaccucccugcaguguugauucccauuucccuaaugauguuaagcguacuuucacgugccuacuggccguuuguguaucuucuuuggagaaaguaacauccauuuuugauacucacauggcuuuuugguucuauuuuugcuuucuuuuggcuaaugauaaccuuccagcaccacgaguuuggacugugcuaaugucuucuaguacuguuuagaaguugagguaaaaagaaaacgguaauugaaagagacaguuguuguuuacauuggggagguugguauuccacccccugugcuuuuucauuagcuguauuguauucuuauuauguguuuuaccggguaauuguaauucuuggcuuuggauuuugucccuuuuuuaggcugcggggcgggggggucgguuauuuuauaagcaaagaaguacagccaguaugauucugaagcaacuaggucacaguagaaaaaaguuggagagugaaaucucaagcaagccaaaaagugauagaugaguuaaaaaaaaaaaaaaaaaaaaaguugccuggcuuggugcaguggcucaugcauguacucccagcacuuugggaggcugaggugggcggaucaucugaggugaggaguuugagaccacacuggccaacauguugaaacccgcucucuacuaaaaauacaacaauuagccaggugugguggcgcacgccuguaaucccagcuacucaccaggcugagaguggaaaaucacuugaacuugggaggcaaagguugcagugagcggagacugcgccgcugcacuccagccugggugacacagugagacuucaucucgaggaaaaaaaaaaaaaaaggcuuuggagcuuccuaauuucuaaauagauuuccuuuauaauuuucagagguugugaaauuaacucuguagauuggggaguguaguuugucacucuaauugcccagcguuuuaauuaucggcguguuuuaugcuuuugugaaaugcucauuucacagcuugcuggugggucuuuuuguggaacgagaaagugaauauucacaccagaaaugagguacugacccugaagggcuuuccagucaaagagaaaggagagcaugacccgccaaugccguuguuuguaagcaggaagcugacgcugcgccaugguguaggggaggaggacgguuuccauucuguuuugagcaucagaauaaaaccaagcaccagaaggugugguucaaagaugcuuuccuuuuucagucucuggucaauuuguuguuauuuuucuucaagagaguuguugggguuggguaggcgcaggggccacaaggccaucuuuauaaggcucuggcauuugauagugagguauuuugguauuccaaauaauugguggaaggauggaaagguuaaauggaaauuauguaagggcugcaaagagauucauauaugacuauuucaugagugcuuacuauauaccaggcgcuguuacagcccguguaaugccaccugggaguuggggggagucaccaucguccauccgucuguccauccauccauccauccugccucccuccauccuuucucuuuuucacaaugucucuugcuccgcccccucucuuccccuccuuccuuccuauccagugcuuguaaccugucaagcacauguuguagccauuggggacaucgugguaaacaaagcaaaguccuugcuugcauucugugacagauggagauaaaauggguaauuaacaaauguaaucccucccacccaccccccacauuauuuauuuauuuauuuauuuauuuauuuauuuauuuauuuauuuauuuauuuuuaccaugucuguuacuccaucagucaggauccaguuaggagacagaaacuauaucauaauuuuaacagggaagauuuaauauuaagaauuauuagcuacaacaggguuuuggcuacuaaaggguaaagagaaucaggccgagcacagugacucaugccugucuguaaucccagcacuuuggaaggccaagguggaaggaucgccugaguccaggaguucgagaucaguguggacaacauagggagguccugucucuacaaaaaauaaaaaauaaaauaaaaaaauaaaaauaaaaauaaauaaaaaguaguugggcgugugugguggagcaugugggggucccagcuacuuggcaggcugaagcaggaggaucgcuugagcucaagagguugaggcugcugugagcuaugaucucaccucuguacuacagccugggugacagagugagaccgugucuuuaaguaaaauaaaauaaaaaagaguaggucgggcauggugggucaugcauguaaucccagcacuuugggaauacgaggugggccaaucacugaggucaggaguucgagaccagccuggccaacauggugaaaccccgucucuacuaaaaauacaaaagugagucgggguugguggugugcuccuguaguuccagcuacuugggaggcugaggcaggagaaucacuugaauccgggagccagcgguugcagugagcuuagauugcaccacuguacuccagccugggccauagagugagacucugucucaaacaaaaaaaaaauuuaacucuaaagaauccaagaauacagauuugggagcagccaguaccaaugggggauggggcaguacacccaggaaagagcaaaucugggguccccacgggccaggacugggaucuggacugggccauggcccauuggauggcagaaagguucucacugaagcccccauaaaggugggacucacugggaaaccgcucucuguggugccagggaaggacgucugugggaggugccuaccaaggaagucucuggaaaucagccugcagggguggagugccgggaaacucccgcccccucccccccuccccgaagugaaccgcccacagggagaugccccuaugggagcuucgcaccagaacccgucugcgccagugucccugcagcgcccucuacuggcgaagcuggacauggcguccgcuggcaaaggggaaacucuucuuuccucccaagccgagcaaugcuaaaugugccugguacugagacgucaucuguggacgguuggcaccgaugcuaaucagugcuaugggaaaauaggcagagcgaggagcguaagaauuauuaugugugcuguuugauagagacuguacaaggaagaccucucuaaaaaggugacauuuggagcagagacaugaaggaagggauugcuggaggcagaacauucuaggcagaaggaaccgcacgugcaaaggcccucaggucagccggcauggcaugcaaguaagccagcugcaacacagcagguguggaugaagggaagagaauuagcauuuggccagagcacgcauuuuaagggauggagauccauuuggauagucuugaacacagaacugaccggaacugacuuacucuuugaaaagaucgcucuggcugcuguguugaguggauugguaagggauagguggugaagacugaaacaggguauccaguuaggaagcuaucacagugauccaacccccagcuucuguugagguugaagaacaugcaugcccaaccuaaauauauguucaaaggugguuauuacuguuugaggugaugaaagaguuuuggagauagaagugaugguuguucaacaucaugaguguaauuaaugccacggaauuguauccuuaaaaaugcuuaaaaugcgcugggugcgguggcucacgccuguaaucccagcacuuugggaggcugagaugggcggaucacuugaggucaggaguucgagaccagccuggccagcauggugaaaccccguuucuacuagaaauacaaaaauugggcgggcauuguggugggugucuguaaucccagcuauuuggaaggcugaagcaggagaauugcuugagccuaggagguggagguugcagugagccaagauugugccacugcacuucagcuugggcaacagaguaagacucugucucacaauaaauaaauaaauaaauaaauaaauaaauaaauaaauaagaguuggaucacagcaaaggugagcuuuaacgaguucagucuagcucucucacaaaaaaaaaguuaaaaugacaaauuuuguguuacauacauuguacuacaauaaaaaccauuuuuuugaaaagaauaguacaaaaaugauacuucccucucaguguauuuuaccaagggauuauuaguguauauguguguucuuacuggaaauguuaauuggaccuguaauucuuuuuuuaacuuuuauuuuggguucagggguacaugugcagguuuguuauauagguaacuucaugucacaaagguuuguugaacagauuauuucaucacccagguaauaagccuuguauccaauaguuauuuuucugauccucuccuuccucucucccucuacccucaggcaggccccagugucuguuguucuuucuuuguguccuugaguuuucaucauuuagcuuccacuuguaagugaggccaugcaguauuugauuuucucuuccugcauuaguuugcugaggauaauggcuucuagccccguccguguucucgcagaagacaugaucgcauucuuuuauauggcugcauaguauuccaugguguauauucacuacuuuuuuuuuaauccaaucugucauuuguggacauuuagguugauuccaguagacguguaauucuucuuggaaauguuaaucuugaucauuugguuaaugugaugacuucuggguucugcagugugaaguuauuaucuucccuuuuguagguaacaaauacuuuggaagagauuaaacaaacaaauaaaaaaguggugauuguuauuaccagcauggcuacuacuagcuaauuccaggcuucaagccacuggggcauaggcauauguuuagcucauuccacaggaggggaacagaggcucaaagaaccuagguaaguuggcuaggcgcgguggcucacaccuguaaucucagcgcuuuguggggcuuaggcaggaggauugcuugagcucagaaguuugagaccagccuggacaacauagcgugaacuuguaucuacuuaaaguaaaaaucaaaaaaauaauggggugcagugguacauggcuguagucccaauuacucaggagguggaggugggaggauugcuugggcccaggaggcugaggcugcagaaagcugucaucaugccgcugugcuccagccugggcaucaaggucuguuuugcagaccuugucuccaaagcaaaacaaacaaacaaaagaaacaaacaaacaaacaaaaagaaauuagguaacuugcucaguggcuagugaguggcuagauuguaagcuucaugagggcaggggacuuugacgauuuugucgguauccuaagccgcuagaacagugccuaaacauuuguugggcaguuaauauauauuuguucuauuaauaaguagagcccgaguuuguguucuccgauuccacaccccauguuccuucuacuacaacuucuggcucuggcuucuggacugucagucauuagcacucccuaucccuaagguuucaggaauguucagcuguuuccuagcuuggaauggaccauccucuggucccacccauggguaagucauuggcugcagagcgcagacauuuggcuccccucgggacauuccucccucauuuaaaacaaugaggcgggcagcaggguacuuugucccuuguguuagcugaaguuggaggaugcuguguugaugggaaaacgcuguuacuauucuuagacuaguggggcucucacuuauucauagcuccgcacucguggguggaaugagaaguuauaauagagugcaggugccucucauuguuuuccgcuacucacuggauaguguuuauuaaaaacgaaaucacaguggugugucuggaguugaagucugaacaaauaacccaaaaugaggagucccuggaaggugggcaggaggcgacaaacaaagagaagcaaaaacaaguuugagcuaauugggaucaggcaguacuuugcaugugaguucugaacagggagcuuggcugcaaaacgauuauuguauuuaacuucuguuggcaucauucgcauacuuguaugggagauccagaauuggaauuuaacacaguuuucccaggcccuucauggaauuugaaaacaugacucugaaagcauguggcugaaaugagacucuuucacacuguuuaaagaugcaugugcauauguugguguccacacaucaacuuaauuuuuucauguuccuugaaggaagcccgucuagguccuucugaaagaagggcuggagauuuuuauuaaacauuacuucuaggcugggugcagugacucaucccugcaaucccaguacuuugggaggccaaggcaggcagaucaugaggucaggagauggagaccauccuggccaacauggugaaacccugucucuacucaaaauacaaaaauuagcugggcgugguagcaggcgccuguaaucccagcuacucaggaggcugaaaaaggagaaucgcuugaaucagggagucggaguuuucagugagccgagaucgcgccacugcacuccagucuggugacagagcgagacaaugucucaaaaaaaaagaaagaguucugaaugaugauagguguuggaauccacguuggugugucucaugucauuuuuucgggcaguuucuugacagacccauuuugugugugugugugugugugugugugugugugugugcgcgugcgcacacgcaugagccuguacgugucccccuccccccccacacauaugcacauaagauagcauaagguaguuccuggcacauggcguuguucuuaaccaugaggugcucccaggcuccgggcaguuccuugaaagacucauugucuguguggggggaggggaggcuguacauguccccacccaacacacacacauacacacacaugggcacauaugauagcauaaggcaauuccuggcacauggcauuguucugaacugugaggugcucccaggagaucuugugcuuccuaucacaugcccauucugcaaguccauccccuuauugagcagauguuuaccgcagagcacuaagacagauggaacgucaccguugcccauagcacucauggacagcaugggguccccuguagcagauauuugugguguaugcucgaagaggggcugcagguagaacuagaaagguagguaaguugggcagauggcgagagacaucacagcccucacuccugaggguggggagccaucucaggcucaggagaagaagagugacagagucaccaacucacuccaucaaauguggcuguauuuuuagaagugucugguuccugaaauaccucaauuccuuuugccugccuggcuccucuccucucuucugccuguucauugaacugaaagauuaucaggacuguauucagcccggccaauaauaucacaaaacaaaaauaucuuguggguuugaaauuuaugaguguuuugacuguucacagcaaugccuuugagaaucacagugugucauccccuccccacccccacgaacauguaguuuuugggcaacuuuucgaugaguaaaacagggccugacuuuuaccccaaagugauguucuuuuguggcuugucuacuccaagaacugagauacccagacucauuucucaucucuuguugaaacagagaagucacuguagcgcccuccggggggugggguaucaagggagaguaugggcuuugaaacugcucaucccgucuacaaccuuggagggcaugguguuucacucccccaccucuccccacaacuucacccugcuccaaugaggaugaaaaugucuuucuuauagaugggacaggagccuuaguaauauggugcgagcaaugguucacauaggggacagguguucauucaaugguggguauuauuauaauaaucauuagcaucauugcuagugacuuuauuuuuccuuuagccaauggagcaguggcuuuuggcccacuacuuucgacugaaucuaugagugaaugugauccuccguuuuaacccugucuuauuggauguugguaaacaguauaucaugagccccuguaagagcuugaauccuucaaagacaaggucagucaguggccaucacuacucuaaacguaagacccugugaugacugacacuuacuagguuucucauuuauuuauuuuucucugcaggacacagcuauguguuccaaagauggucuuaaaccuauaggaguauaacaccauggcuaguucagaaaaccuuauuccaacuuccaaacuuagaagauacugggaaguaaaagggagagaagggaaugcauggcuugggcuaaaaaaaugauucugcauucaucucagaaggauguuuuccagucuuucucuagaaacaacuuuugugucuaaggauugugggugaacaacagcagcacaggcuacauuggcuuggcucggugguugggaugguuuggcucuuacugggcaguaagcacaguggcugggauaggaccuuggcaucucgugcgaagccccucugccuggaguccugccucugugacacuugcuuacugugugaccugggucaacucauaccuacuguucgucaguuuucucaucuguaaaauggggauuccagugguuauuaugagaauuaaauaugacgauacauaaauagcaccuggaaaaguguuuaggaaaccuugacaugaugaccuguuuagcagcagcagugugugccauacuuaccuuuauggaaugaacagauuuggagugaggauggauguuuagcucacuuuauuagucuggucucacacugcuauaaaaaacugcccgagauugggaaauuuauaaagaaaagagguuuaauugacucacaauucugcauggucggggaagccucagaaaacuuacgaucaugguggaaaggaagcuagugcaccuuacauggcggcaggcaagaggggcagggagggagagagaaagagggagggaggaaaccaccacauauaaaaccaucagaucgcguaagaacucgcuaugucaagaauagaaugggggaaccacccccaucauccagucaccuccuaccaggucucuccccuaacauguggggauuacagcuuguauuacaauucgagaugagauuuggguggggacacagccaaaccauaccacucauggcaucucguuuuuacagaguauauguguuuucagauuuugcaugacauuuuaggauaaaugugaugaaaaugaggaaaauugggaaugaaguuuaggucagaaaaguuucagugauuauuuuuucagaaucauuguuucuugguuucuaggguccaacaugccauuguucaauggcuguauuucaauggcuguauuucagaggcuguauuuuuuuucccaucucuuccuuccuacuuagaagacagugacauuuccucugugccucucaggugucaaugccauccaacaggaauuuguacaaagaaagggaggacuuucugaugauguuguccaggacaguggccccauguagcuacugagcacuugaaacgugacuaguaugaccaggggcuggacuuuuaguuuaauuuuuuguaauuuaaauaauuuaaguagcugaugugucuaguggcugucguauuggaaagcacagaguagacauugcaaauacagacguagaaagacaccgugccugcugcuaagaggccccugguccuacugaguggucagcuguuuacacugacagucccagcgugguauaauaagcauuaacacagagacauguacagggugcugagaaagcuaauuuuugcaauagucaaaaaagaccucagggcagacuccccagcacagaguuccaagccuuuaccuaaaaagguaaucauuuuauaaguaccuauuaugugccagauacuaggauaggcacuuugcauagaaacucacauuucgacugggccugguggcucacgccuguaaucccagcacuuugggaggccggggcaggcagaucaugaggucaagagaucaagagcaucccggccagcauggugaaacccugucuguacaaaaaauauaaaaaugagcugggugugguggcacauaccuguaguuccaacugcucagaaugcuaagguaggagaaucgcuugaacccaggagguggaaguuguagugagccaagaucgcaucacugcacuccagccugggugacagagugagacuccaucugaaaaaaaaaaaaaaaaaaaagacauuuacauuuuaucuuuacuguagcuauggcugccuaucccaaggaugggaagucugaaguucaaacuggugaugauccccaccccaagucacacaguuagcuuuauaguuaaaucagggugugccugauuuccuagccauaccaggcagccuauuucuugaauaaccucccauccccugugucuccuuuguggagcucuuggcaauacucuggugauugguaaccacugauacgccgccagcaguccacgcuuggguggaaggcagguuucacguaacugauuuaccacuugguaaaggaacgaggugacagcaagaccacaaacuaauaaauaugccgguauugacauaaugucggaccucaguaugauugaugcauguguuguugacugggaugucacauguucaggcuguaauccuggucucaguaugacugugaggacggggccaagucauuucacaauuugggugaguguuccaagcuucucagaagagcgacgcaauagaaauucaagguaugaaauucaagguguggucucagagucauuuuaucuuacagcuucucugcuguguuuucucaguaugugaaaugggaacaucacuuaccaucuacucaccuccuguuugaguucaagggaagguuugcagauuggccugaaggaagacuucucuugaaaaacucaaaccaaagagcacaccgccguccccaacccugagccauuucuguccuuuucauggaaagggaacuguguucgccagcucguaaagccccggcgucuccuccuagaagaaacacccacauugacccagcaguguucauuuucccauaagguggugcuggauagggauaggaugucgccccuuguucaccccuuggcaauaaucuguuugauucacuccaaaugcugcuucugaucuccaucuauuucaggggaugaccagucugaauaaaaccaaugagcuuaaucuacuuguggaauguuauagccggaagggauucauagagaucacucuaucgccuaaaauucucucuucuacauaucucaguguuggaaaacauaaaugugacuccaacuugucuuuuuuguuguuuguuuuugagacagggucuuuguuucccaggcuggagugcaguggcaugaucuuggcucaguacaacaucugccucccuggcucaagggauccucccaucucagccuccugaguagcugggacuacaggugcaugccaccacaccuggcuaacuuuuauuuauuuuuaguagagaggcaguuuugcuguguugcccagacuggucuugaacucuugagcucaagaaauccuuccaccucagcuugacauuacagguaagagccaccguguccggccccccuuucuucuuuuuuaaagugggguauuaaggcucagaaaagaguguuucugccacugcagaggauugcugacauuauuaguugcucacucuguccaaggcauugugcucagcucuuuguacagauuguuuaacccucacaagucuaugaauagaguauauuacccacuucauuuuaaguaggaaauugaagcucagggaaucguagcagagggccccaguucacacugcugaucagugaugcgacugggaucaccacagcccaucugguucagaagcuuguucuccuaaccaggaugugagagacauucuuguccuaggcagcacguugguggcagaggugggaucuagacugaggcucucauucuguacccucucuggccccaaggaaggaaaggggaaggagaagggccuuugggacuggguggauguaacacuuucugccaccucuacucuuccugcuauagauuaaaacagaagcucugaauugcagccacaaaucaauaaugaaaagcuaccagaccaagcccuuucuuguuuaguguugugucuucugugucaacaucucuggaacauagucaauggcaguacccaguagaagccauauggauacuuuuucucaaguguugaaauaaauuaaugguguggccaugguucucguacuucaggucccugugagccccugggguccuacacaacuugggguaaugcuauggucaccugcauccccuccucuccagcccucaccugguuuucucuucuccuuccaagaaaaaacacccauaccauucuuaacaucucuggaagcugggggucaggagagggagauccauaaaguucuugucuuccccgacucaagaagcuuaaggguacauucacucacucaugaauugacugguuuauucauucacugguugauuaauucauucauucacugguuaauuaauuaauucaugucauccuuuggaugucuugcagagcugagugcugaaauaaaaugauaaacaagucaaaaacaaaaaggccucugacuuaacaggacuuccgugaugcgggggaagaagacaauaggcaaguaagcaaguaaauauacaagauaaauagaaacugugaugagggaguuaaagaaauuaaacugguccuuguggaagcaacuucgggggaggaggaaagacagggaagaccauuuuaaggaggugauguuugaacuuaagaaucaaaaacagugcaagcgcugcaugggggagaacagucuaggcaaggugaacggaagugcagggucccugaggcagaaaggagcucagccucuuuguuagcuagaacaagaaaggggcccguauggcuagcauaggaugggauaggggaucgugguggauaccagcuaggauuucacuguaaaagaagaaaggaagccacugaagggcauuaagcagggcagugauguuuuuuaaagaucugucuggcugccuuggggagcauggguucagagagcagcagcagaagugugcaggaugacuuggacugucaccuuggggccagccugcagacugguguggccgaaggagugccgugacuccucugccaccucuccacauuuggaagauuguuuugcagcugcaaccucaaaacagaagccuccuaauuaccagguagcuuucuagagccaaacaaaugcuguuguuucugacagguaaaucaagacagggaaaugaugacacauucaccacaacugaaguguugaugggguguguugugaccccuggcuuguuccaaagccuaugugggugggaauucuuuaaugucugccuggaacugggcacucagcuauaaauagagcuauuuuggaaauucugcaccucaauuucuaaaaaguuggaaggacaggaaaggggagcuguguuugagaucucagaaaucugcaccccaccuugcuauccaccacugguauuccgucagucuuacuacccccucccaccucuagcccacccucuaccauccucaccaggaaggaggcugcauucauuucaagaacugcuuuucuuuuaucagcuggcauuacuagguauagacauuaugacccuuuaaugggcgauggguuaauaccuguugcuuuugugugcuuccuauuuaaaacauguuuaucuaucccccacccccacuuuauccaaaaguuauucaguguuuuacaaagacaugaauauugggccgggcuugguggcucaugccucuaauccuaccugaagcaagagaaucgccugaacuugggagguagaggaugcagugagcugagauggcaccccugcacuccagucugggcaacagagcgaggcuccaucucaaauaaaauuagucagucaaagacaugaauauuuucuucuaaguagaaguaaugaugacgaugaugguagcaguuaugagcagguaacaugcauugaacacuuauuugcuccaugcaauguucacaggucuuuacauguaaaaacaacccuguaaaauaaauaacauuauucucuucauucuccaaguaagcugaggcagaggauuccagcacaagcaauuugguuccaaaaccugcccuuuuaaccucuaccagauuuuggugaacucucugucuuuggaaggguagguggcggcugcggggagaaauagaugaagcuguuacauuuggcagcaaauguaaaucaccaccuucacuggcuuuaauuucccccuccagccuucucgccuugccaucaccuucacccuguccuuccucuucaggccaccuaucccuuccgauugaccccacuggacuucucugcuccuggcuucugucuucccucuagugaccgcugucuuuaccuucagcugcacgagcuuuuucaagaaccuucuugcucccucuccauccucucuguuuuccuacuuuucuuuggccacuguuuuugccacagcuucuaggauuucucuuucccacaaucuaggagaaagguagagcucucuuaugcuggggcaacgcuaccaacauugguauuccacagcauuccaacgauucuaaauacucucccagaguagggaggaaaaaucauccaaacuacuugguaauugaauucaagagugauggaccaaaaauuauuaaugcauucccuuccguccaccagccaaagaggauuccaucuuuauucuccucccaaaugcaggcuccauuaaccuuuuaccuuucuuucuuuccggucuuucuuuucuauaucuuuuuuuuuuuuuuuuugcauuuuuccaauugugaucauacuauauaugcaauuugagguauuucagacaacauuauuacaucauuacagaagucucauaugcuguauuuuauaaauaugugaugcaaucaaucauugauaagauguacuguuauuuuauguuucacuaagagugcgaagaacauuguuaauuauacaaugauccaaaaaugucuucucucucagaauguauuguuuuauaucuauuacaaaggcucuuuugacuuaggcauagauuucucauacaucaggccauuucuaugccugccugugaacacagggauuuugaauuacaauacugaauccuagugugaucuuucugaagucauuuuaauuaucacuuaaacucaauauggaaagcaucagcaaugcaccuauaugcacaaaaaugagcagcuaugaucaaguuaucaggaaaaaccaaaacaaaacaaaagcacaucuccaucauuuauaauggcccaucauuuauaauggcugccugauaauuggagauacaugcaccagacuugacuuaacuguucucuuagucaucagacauuuagauuucaacaggcuccuguuaagcucuccuuacaguguguguggcacugugcaguugaaugaaacaugccauggccaguggagacaggcuugggcugauggagagggccuacagggccaggccuugaaggggagggaaauuguuagcuacacgaccaagagacagaagagaggaaggaguuuguacccacaacucagcuuuauuuuauguaagcucuuucugcaaagggaaaguagcucuuuguaccaaagcaagggccucugaaugagagcugggagaggccagaaugggccuguaagagguugauguguaugagaccugaagcccuaugccuuugggaaggagaggaaggaguaauauuugugugguacaaaggaugugccuggcauaccccauaucuuuuacaaagacauaaaugucuucugaauaaaaguaugaugaugaugaucauggugaugaagaugagggugaugauguugauguugaugaugauggugauggugaugaugguaguaugauaaugcugaugguggugauggugauaggagggugauggugaugaugauggugauaagaugcugaugguggugaugaugauggugauaugacgcugaugauggugaugacgaugauaauggugaugauggugaugacgauggugaugaugaugucgauaaugauggugaugcuggugcuguuggugauggugaugcuggugaugaugauaaugauaguggugauaauguuggugauggugggaugauguugauguugaugauaaugaugaugauagugaugaugauaucaacagauaccauguacugagcacuuacuuuguaccaugcaaugcuuaugguuuuuuaaaugcauuuacaccaaauucuuauaacaacccuauaagucagugccauugcuuuucccauguaacgugcacaucauucaaucacucaacccuugucauagguagauacuauuauccuccuuuuauagaugaggaaaccuuggcuuagaagggauaagcucaaguucacaggcagaaaagagacagccagucaagcccugacuccuuuugugacccugaugagauuacagguccucagucuccucauuguaucugaagacuaaagaaucagaaaucugugacuccacuuaguuuuucuccacccaggagcccuuaggccgcuggugagugaaguucuuacccauuagggauuauuaauauacuagauaagaguacagucucuggagcuaggcuugugacuuugaacaaauuauuuuaucucucugagcucagucuccucaucuacaaagggggaauugauaauaggaauugucgcaaagagcuguuuuaaagauuaaaugagauaauagauauaaagcacuuagaagagaguuuggcauuugcuaggcucacagucagugucagugguucccaauguuacuguuuuagcugcccccagucaggugguugaugaguuggggagccuggugggcagucuggaagagagcacagugacugcaaggucagcuccugaccuucauaauaaggacucacaugugucggucccaaggauccccaagggauacucaugguugaaggugucuauguguucuccuugguguccagcgaaugccucuugacaaucuguggucauacucacaaccuaugaccacauacgaggaagcgaggugucccuuuugcaguuguucagaaggucccgugggcaggagcagccagaggaacaugaaaccagcucguaggugguacuuguggcaacagcaguuauagccaaggagaaguuaaauucuaaagacuugggcagucuccagggaauauacuaacugagaaauaacauccauaaaaauaauucaauacuaguauguaaaacuaaaaacaauaaccaagugugacuggcugucuaagaauuaagcaaaguaagaugaagugucuuuugcuagcaggcgcucucagcaaaggagauaaggcugcaguaauucucuucccaccuucgaugggcaggugcaaccuuuggcugcagaaauucucacuucccagcagcagcuuugagcacccugcucugaauguuucuugggcagcagcagcuagggaagaaacucaguuaaggcuguuugaggacccaagguggucucacucugcaacacacaucggcagccaguggugugcugguaaaugauuaacaacuggcucucugaaaaacaaacaaacacauugugcaccuauacauguacacacacagcuuauuauuuauuauuucucugaaauauggguagcauauaauuuacaaauaagaagaagaauaguauacacaguacuguuucuuauaaauucgagauagucaguuuuuaccaaaugcuucugauuuuugcugcgcuauuauauccauuacaaaaccauuguugcaguauaaaauugcaguauguagcugugacaugaauauugguugauauuuucauuuuuauuaagaaguaaggcaaaaacaaaauaagacauaugucagaacuucacuuauccuucuuugcugaauuggauaaugguuuuaaaauaccaaaaaauauuucuucaauuuuuuucugcuacucauaauguagcaucuguagagcgacacacuuuugaauuugaguuaauauuucuuuuuuauuuuauuuuauuuuuugagauggagucucauucugucgcccaggcuggagugcaguggcgcgaucucugcucaccgcaaccuccgccuccuggguucaagcgauucucauggcuuagccuccugaguagcugggaauacaggcacccaccaccacgccuggcuaauuguuuuugaauuuuuaguagaggcgagauuuucccguguuggccaggcugguuuugaacuccugcccuccggugaucugccugucuccgccucccaaagugcugggauuacaggcgugagccaccgcgccuggccugaauuaauauuuucuaccccacuuucuuaagucgagacaaucaauaaagcaauaaaugacaccuggauuuguagcgaaugucuauuuccaugguguaaauagugguacccugagcaauuuuaaguuauaaauaugagaucacugaaaguggaguuggggaacacguuauuauauaguauuuucaccacacacaggauacagucaaugacuucaagagcauagguaacaguaaaauguaguaaaacaauuuagaagucaugaguuuugaguacuuaguacuuuuuaguaugauuuauuuaauaguaaccuuauauaauguuuuucuuuuaauuguuuuauugagauguauuucauacacuuuccaauaagcccauuugaaguguaacauucaacuuuuuuuaguauauucgcaugguuauguaauuuucaucaaaaucuaauuuuagaguaucuuuuuguccccguaaaaguaacucugugcccauaguuggcaguuugucauaucacucaaucacuguuuccuuuaaagagcuuaucauuaaagacagcaggcaguuacacaacaucuucuacaugccaagaauguuucuaauacaugcuuuauggauuuuuaaauugugguaagauuuacauaauguaaaauuuaccacuuuggggcugggcguggugacucacgccuguaaucccaacacuuugggaggcugagguggguggaucacuuggggugaagaguuagagaugagccugggcaacaugaugaaacccugucucuacuaaaaauacacaaauuagccagguguggugcugggugccuguaaucccagguauucaggaggcugaggcaggagaaucgcuugaaccugggaggcggagguugcagugagccaagauugcaccacuggacuccagccugggcgacagagugagacugugucucaaaaacaaaaauaaaacaaacaaaacaaaaaaaguucaccacuuugaccauuuuaaaguguaaaauucagugacuuuuaauacguucacaauaucgugccacaaucagcagccauuucagaacauuuuuaccaucccccgcuaaagaaacaccauauccauuaaguggucauuccccauuuccuccuucccccagccccucauaaccacaucuacuuugugucucuauagauuugacuauucuggauaucucauauaaauggaaucacacaauauguggccuuuugugucuggcuucuugcuuuuagcaugcuuucaagguucauccauguuguagaauguaucaguacuucauucuuuuuaugguugagugauauucuguuacauggauauaccacuuuuuguuuauccauuugccaguggguggucauuguguuucuacuuguuggcuguuacgaauuaugcugcuaugaucauacauguacuguuuuuauguuuucugcaaacuccuguuuuccauucuugggcauauuuuggggaguggcauugcuggguaauauggcaauuuuauauuuaacuuucagaggagccaccaaauuguuuuccacggaggcugcaccauuuuauauuuccacuugcaguauaugaagguuccaauuucuccacauccuugccaacacuuuauuuucuguuuucuuugaagguaugaaauuguaucgugguuuugauuugcauuucccucaugauuaaugauguugaguauuuuuaugugguuauugguuauuuguaucuuuuuuaaaauagaaauguugauucaaguccuuugcccaguuuuuaacugggucaucuggcuuuuguuguugaguuguaaaaguuguuuauauauuuuggauacuagacccuuaucguauaaauccuuugcaaacauuuucucucaaucuauggguaggcuuuuuuacucuuuuuauagugucuuuugaugaacaaagauuuuaaaucuugaugaaguccccuuuaucuauuuuggauguuguugcuucuguuuuugguguuguaucuaagaauccauugccaaauccaaggacauaaacauuuacuccugugguguuaugauauauauaggguuccuggcucauaacucucauagcccuuguugcagucuauuguuacaauauugccuguguuaggcaucaggaaacagaaucucuuugucuccuguccuucuuucaccugccccaaggcaggacucuaaucuuccccaccuuuuugauugugagucuucagacccuccccagagagucaguccugccuuaugcccuggggaaaggaaugcugaccucaugaagcucccauaaaaacccaagagggcuggguuugggagcuuccagauagcugaagacaaggagguuccuggagcguggcugccuaggaagggcuggaaagcuccaugccccuaccccauaccucgcccuaugugucuuuucaucucuguccuuaguacuguccuuuauaauaaagcaguaagggguagcaaguguuuuccugaguucugucaucugcuccagcaaauuaaucaaacccaaagaggggguuaugggaacuuccaccugaagccccucagccagacauucugaagucucugacuugcuauuggugucuggggguauggggggcagucuuggggacugagccuccaaccuccaacuaacuccacguagacagugucaggauugaauuggaggacucccagcugcuguccccugcuuaguauguggggaaaguugaguuguaaaaguuguuuauauauuuuggaaacuagacccuuaucauauaaaugauuugcaaacauuuucucucauucuguggguagucuuuuuauucuuuugauaucaucucgugaugcacaaaaguuuuaacaacaaaaguuuggguguuguaucuaagaauccauugucaaauccaaggucaugaacguuuaccucuguggugucaccccuccucucgcauuuggugagaggagucuucuguguugauugucaugguggugugagagcagaagggaaacaugguuucagaaaagaguuuuucccugaaaccaccccucuauuuucuucucagacuuuuauaguuuuagcacuuauguuaagacuuuugauccauuuuacgucaauuuuucuauauaguuuaagguaggcauucaacuuuguucuuuugaaugugaauauccauuugucccagaagcauugauuaaaaaagauaauucuuucucuauuaaauggucuuugcacccuuaucagagaucaauuggccauaaauguaaguauuucuuucuggacucugaauuauaucccauugaucuguaugccuguccuuaugccauugccacauuguuuugguuacuguacucuguguaaguuuugaaauuuggaauugugaauucuccaacuuuguucuucauuuucaagauuguuuuggguauucugggucccuuguauuuccauuugaauuuuaagaucaauauaauuuaaauuuuaaucauggcaguguucaauaacuggcuugcauauuuuuugaacagucaucagcucuugugagccacgguuggccagcucccaaacaccaugacauacaacuugcaggaaaagcucauuuuccaguuuuucccccuccagcuguaggggauauauuuucguuaauuccugugaccauauggcagcaugguuaggaucuugggcuuccaaaucagacaguuguaaacuuaaacuccaauucugccacuuauugugucacuuuggacaaguuacuucaccucuccaagccucaguuucccugacuauaaaaugcuaacaauaguuguucuuuccuuauuggacacucaagaggauuaaauauuauucauguaaggcucuuaguauaacaccuugcacauaggaagcauuuaauaccuaaaaucgaguacuguuauuguuucaggauuauuauuuuuuuuaaauuuauuuuauuuuuuugggacagggucuugcucuguugcccgggcuggagugcaguggugcgaucucagcucacugcaaccugcuuccuggguucaggugauuguccugccucagccucccuaguagcugggauuacaggcgcacgccagcacgccugacugauuucuguauuuucaguagagaugggguuucaucauguuggccaggcugcucucaaacuccugacaucaagugauuugcccgccccagccucccaaagugcugggauuacaggugugagccaccgugcccagcucagcauuauuauuuuuagucuacacacagugaacuuaaaucuccucuagaaaagucagaaggucuaccuacaacuuuaagaguucagccaaaagagaccaguaucuacuaccguggacaacccuauuuaacauggaggagauaagcagaaacugaaaagaggagccuguuuucucucuggcagauuaauuuucuuucuuucuucacccaugccuuggacaugaaacacaaguacaaagguucagagaaaaucaaaacaagacugugguuuacaaauaaguaguacuaguaacaucucacuguuggcugggcacagugacucaugccuguaacccuagcacuuugggaggcagaagugggaggaucacuuaagccuaggguugaagaccagccugggcaacauggugaaaccucauuucuacaaaaaauacaaaaauuagccgggcguuuuggugcuugcuuguggucccagcuacucaggaggcugaggugggaggaucaccugagcccaggagauggagguugcagugagccaagauuacaccauugcacuccacccugggugacagauccagacccugucucaaaaaaaaaaaaaaaaaaaaaaagugaaaaaaaggaaaaucuucguuguucuucaucagaagccuccacacagggccccugaaggaagggcagggaagaaggggguuggaggucagugggaggaauaacucugugacucagugcuuuccugacuaccaucuggaugugggcuguaucugcguaaggugccgggacagggcggccucaugaacucaugggaagcaaacacacacccucccuccgauccaccaggcacucggguuuccugugugucuggugaugugcuggguguuguggaucuggacucaacggcagucucagguuuauguauuaggaagcauucagcaggcaggagcagccgaucugagacuggcaugggcaguggagacaucauucaucuccugaaacguaauuuggaggagacuguuccagggcuggcugagugacuccuugaugucagcacuuugcccugucguggucuuggccuuucucuuguguuccccagauggguuucacugcucuaaggaucauaccuucgcaggccaucugaaguuagugaaucugaggcaaacagaagggcugggugcgguggcucauaccuguaaucccagcacuuugggauaaugagauggguggaucaccugaggucagaaguucgagaccagccuggccaacaugaugaaaccccgucucuacuaaaaaugcaaaaaauuagcugggauuugguggcgccugccuauaauugcagcuacuuggaaggcugaggcgggagaaucacuugaaccggagaggcagagguugcagugagccgagaucgcgccacugcacugcagccugggcgacagugaaacuuuugucucaaaaacaacaacaacaacaacaacaaacaaacaagaaacaaaaaauacauagaagaggccuucucuucacaaguuuuucuuauuguuuuuuguuuuuuuaagggaggaaauuucuuucagaagucaguacuggacauucccuuauuucaccuugagcuacacaucccauagucagcuuagcccugucccuggugcgggggagcaggacgguugccuguaucccuuagucauugccgcaggcuugcugcaucacaaaccaccauuagaccucaguggcccgcagcaauaaacauucgauucucgccaucucuggguuugaggugaccuuggcuaagcuccccugcauugcucugcucaucuuucucacgagucuggcaauggggcugggaaugggcugaucuaggcuggacuuggcuggaguaacccagccccaccuuggaucucucuccucuacuucccacauguauccuuuucaugguuaaagguagaaacagaaaaaaacaggcagaaacauaaaaagcucggagauggcuuccuauugcuucuucauucugggccagagcaaaucauauggucguacuccagggugaggaaguaugucccacuuacagacugaaaaggugcugcaagucugcacggcagagggcauggauaagggguucguaaaaacuuagggccauuuaauacaaauuugucacaucacacuggcuuggauugauuuugauucauugcucugucgcccaaacagaauuauaauuauuuuaguaaggaaagaggaaggauaccuuuggggcagacaauggauagagcuuacuauacaagucuauagaggcaucucaccuguagaaaucuuaagaugaggguuagccaaagcaaagagugguucagggugggaaagccaaggaaggccaggauccucaccaagauugccagcagggagcucugauuguccacagcucugcucucugcucaccccggggauuuagcaguaacagaauccacacuagaaggacagagugcuguacagacagaaggaaagacgcagacccaaaccuugauaaccauggcaaugcaauaggaaaucucuuuauuucguuggugcucaagugauaccauuaagucccuuaagaugcggaauuuccuugcccccgcugcccccuuucuuucuuucaucuuaucuauauaucuguaucuauaucuaaucuauuuuuugagaaaggcucucacucuguugcucaggcuggagugaagugaugcaaucucaggucacugcaacugcugucucaugggaucaagugaucuucacaccucagccucccaaguaacugggaccacaaugcccagcuaauuuuuauauuuuuuuguagagacgguguuuugccauguugcacuggcuggucuggaacuccugggcucaggagaucugccugccucagccucccagagugcugggauuccaggcgugagucaccaugccaggccccugccucuguuuaaaugcucaaacuugguauggaacugcacagacuauacggcugcucuccacucaagaauacaaauugaacauugacuuuccucauuuuuuauccaguuuugcuuuccagagacccagauauggcuucauuuuuuaaaugaaauuuugcaggucauuagcucauaaugauuaaaugauucugguuauuagcauaaaacacagcuguaguacauaagagguaaccuuuauuguuuaaauauuauucaaugugccuacauagcacacagcaaaaaaaacuuuuuuucagacuauucagccauuauggaaauaacuuauaauuacauucagaaauguugcaaaugcaacucauccuugcagugggauaaacauugccuagaaggguuugaagaggaauccagguuagaaacaaugaaaauuuuuggcugggcaagguggcucacgucuguaaucccagcacguugggaggccgaggcaggagaaucauuugagggcaggaguucaagaccuccucaucucuacaaaaaauaaaauauuugaaaaaaaaaagugaaauuuuugauauagaagaggauguagggcagguagggcucagaaagacccaugccauauagcaaaguucuuaguaacacaggcuuuggguuacagcaggcuagauucaaauccugcuguggucagaaugucugugucaccccagcauucauuuguuaggagauggggucuuuugggagaugauuuggacaugaagacagagccugcauaauugcaugagugcccuuauaaaagugaccccagaagcugccuugcuucuuccaccaugugagaaaacagcaagaagaauauccaugaaucuaugaggaggcgggacucuggccagacauugaauuugcugcuuccuugaucuuggacuucccagcuuccagaaccaugagaaauaaauuucuuuuuuucaaagcuccccaggagucucucucggucuguucuggcucaggaagcugccuuauuuguaacaaacaaauaaacaaaaaacaaaauaaauaaaagcuacccagcuuagauuauuuugucauaaaagccccaaaagacuaugacaaauccuuccaucuauguguccuuaggcaaaauacccaaacucucugaauaccaauuuucucauccaaaaaaaugggugaauaauaucuaagagguaauaacccuaauaccucuuaguguugcugugagaauuaacuaaaguaccaucuucauguggucagcacaauggcugacacauagcaagaccuugguaaguuauagcuguugcugucauuccugcagcuguuaucuuugucauuacgcuuacuguuauuauuagcucugcuaucagagugaugcuguggcuggagaagauggagacccauguguucaggcugugagcauaggcagauccuuucuaaugcagaaggugcagacacagggcacagaacugccaacuguggcugcugacaccugucugacuuugacuggguuagugacaaagaaaugacuugccuuuuguauguuagcccugugccuggcauacugcaaauaucuaugguugauaaauuaauguuaucaucaucacguaagcaucuugggaagucuguaaguaaugggaguuggaggcuuaacacugaucuuugagcuggcgauuuuuccagccaacucauuuuggacguuggugcuuaagcauauccuguuuucgagggugguguuggugguggaggaggugauggugaugauauugauaaugacagcaagaaugucuuacauuuauagaguguucaaaaggugccagauauugugcuaagugcuuugcgggcauuauguuauucacacuucacagauauucucuuucuacauguaaggaaaaaaaggcauaaauacuuuauauaauuuacucaggauuuuaaguagaggguagauuuuaaguccaggcaguccaacccccugaaagcugacucuuuaacaccauaugcuucugucuuccuggcuguuuugugaaugaguaggauggaaaggagauccuugaauugggaaggcuacccauggacuacaacuaguacuugucuucaaccuccaucuagauggagugcucacaagauccucuacaucaaaccuggcuucuuaguccacugcugagucuucccaauucugaaaaaaaggauucaggguauaauuucucacacagauuucugggacagugcuuucuuggagcaccacgccucacuaauggaacacucauguauaauucuggcuuuugaauuuuuauuuuuuuauuaacauacacagucagcauuggguguggcucuggggauucauucuagugggcaagucucauauuucucaaccucagguuuuucaucuguaaauggggacaauacugacaucuagcuaauguccuugaggauggaaugagauauugaguauaaaguaucuaguagaguggcuagcguauagugaguacccaauaaaugcaauagauguuggcuuuuauuacugucaaguggaaacaaaaguauaagguuuaaguaagcgaacgaaauggaagauaauugaggaagaaaaucagaugaugucuaagauaaggcaaagaacauuuugugaauguuuaaauauccuaagacccacuaaggaaguuuguggcaauauuugcucaaagacaguauauauaauaaauacuuuagacuggcuaagagaauggcucugaaugucuaccuagcuaucacauuuagaaacgccccuugccuuccuuccaggacuuucuuccuuaaucaggauugacuuaacuguuaacuccuagaacugucguugauugcuugcugaaguaacaauuaguauagacauucagcaacuggccucccauacugugauucacugacccagacuuugacaucuugggcucagccauacccuggagccuccaaauccucugcuggauccuuuaaguccagacaucugacaggggaagaaaaaguacaaguuuccaaggaguuauuauaggucaagccuggaagcagugaggucacuuccaccugcuucccauuggccagaauucagucacaugaucacaaccaacugcaagggauucugggaaauguagucuggugaugccucgaggaggcaagagaaauguuuucagugaacacauugccuucucaggcuugcuuucuauuguagauugcuuacaauauugcuuuuaaauugcauggucuuguacaaaugauacgaguuuuauuuugccuuuuggaaggaguuauuguccauauuuguuagagauauaucuguuuaucagcaucauugcaaaguauuagaaagggcccugccugggcuaggagccagaagcauucuucaguucccaacggccauccagccacucauugcugugugagcucuggcuggucaguaagaaccuuugaucccauguuucuuuaucuucuucuuuuuuuuuuuuuuuuuagccauagucucacucugucaccuaggcuggagugcaguggugcgaucucggcucacugcaaauucugccugcuaagaucaacugauucuccugccucagccuuccaaguagcugggauuauaggcaugagccaccaugccuggcuaauuuuuguauuuuuaguagugccgggguuucaccauguuggccagucuggucuggaacaccugaucucaagugauccacccaccucagccuccuaaaguguugggguugcaggcgugagccacugugcugggccccaacuuucuuuaucaauagaaguggggaaaucguaccugcccugucugccucauuggauguggaagaaaugacauaauccaugagaguggcuucugaaugaagagaaccugcuaaagggaagacaugaucucaagucagccaccucugacccaaauaagaacacauaauuacaagacuguauuguauaaucaugcaggacacaagguaugcaauuuuaagggucaaagugguaaaaaaaaaaaaaaaaaaaaaaggaaaaucaaauauaaaaaggcagccccgacagguacgagcuuguagucauuuccccaaaugccuaaaguagacccauucccauugcucuaauuuguagagauguucucgaggcagccuggagucaagacaagagugccagccaggauugaggcacuguuccaacuccagucuggcugcuuuuucaaccuggggcuuuagucaugucaauauuccugagcuuccaugugcuuauuugaaaaauaggaagauucguccagucucaaggaacuaugauaaguagcaaacaauaucccagaaaaaucuccaggcaaaaauccacuggaggccaggugcguuaggucaugccuguaaucccagcacuuugggaggucgaggcaggaggaucucuugaggcuaggagcucgagaacagucugggcaacauagcaagucucugucucuacaaaaaauacaaaaauuagcugcgcgugguggcgcgugccuguaguccuagcuacucaagaggcugacaugggaggauugauugagcccaagaggucaagacgguagugagucauggucacaccacugcccucaacccugggugacagggugagacccugucucuaaaaacaaaagcaaagucuacuaaaaauucacuggagcuaugagaaaucuuagcccauggaauccagucuucuccuuuuguuucuggggaagcugagguucagagagaugggguagcuugcucauguuauauagggagcaaaggacagagcuuggaccagagcgcagaggucaugauaccaaagccacggcaccuuugccacaacgugagcaagaaaggauagccuuguuauuuuuaauccaaacugaaguuaugcuuugggcuuccagaaucugggucaaaaagaguagaagucaggcucagauugacgcuuuucaagagagagaaaaaaaaagaaaaaaaucuugccuuucccuagcuagaggucagaugucaaaaaagcuaauaacacaacccaaggaugucaucgacaaaugaaaaaacuggugcgaugcgggaacaaaagcuauuuuaucauuaauaugccgcuuuuuuguuauguacucaugccccagaaauuauuguacagccuguacuugaguccuuagacagaaagcaucuuaucauucacaagcuuagcuaugcaauauauuccucccuccccccaagguaguuguuguuggguuuuuuuuuuuuuuuuaagagauuuacagugaucuuuccauauagguuuuucucgaaacauauauauuuuuaauuucucaccaucucagggguaaauaaauauauuaaaauaagcuaugggauguacagcagaguauaacaaugauaaaugauguuguguguaauuuuucuacuauuaacauaaaguaauauaaacugaaggacacuggucuauugagagacuuagaagcuaauguuccauaucagaugcggccaaugucaggacugaauacagauuaggcaguguccuuuucuccccaggggaauuaaaguuugagacaccacuugcugccagugguuuuauggcauuuuguuggggccgguggugccuuucuuggucuauuaauucaggagccguaaacaacaaugugagcaaaaugcuuuuccggugggaugcauuucauuuauaugugcuuguaucgucuauaccuugucaauccauuuugucacaauaaguguuuuuaaauuguguagauuaccuccacuucauuaugguuccuggcauuugugucuuaugcaaggcuauuaugugaaguuaggaaauauuuaaaacucugccuuucuaaagaaacagggacacggugcagaaaaguucaucuggaguuaggcuugugucuugccgucucuuuaacggagaguucaugggcaggguacagucugugagaaggaaugaaaaccccaggguagaugcuaacaaaaaucacuuuuaaaaaauguaugguguccaucuggguuagcaaacacaugcucacacgucugugcuugcuggauuuuuaagaacuuaccagcauuuaagguuuucuuaugaaacugauuuuacucaccagggauagagucucaaaguuggagguauuuuauguuguuuuaaauaauaucgucaucacaugucauuuuagaccccaaaaguccacuccgaaucucugcguauggaauugaggaggggugaggcugucagaagccgagggacuuggccaaggucacauggcuuuggacggcccccugaaccuuggagcucauguucuguggcacuuugcauacugaccuuucugcucuuuuaugcugccugcucucuaauauuguccaaaaaccuucucuaaagaaaguacacaaauggagagagggggaauugggcaugccauugggagaacaaauuuauuuagauaucuuuggcuguguugacagaagcugcccaauuauacccaauauacaaauuuuaaaugcauauuagucaaaguuccaguuauguagcuuuagaaaaauuucuaugugaaugacuacuuuucccugaaauacguccuccaucucaggcacuaguuaggaacuucccccgcgucuggcauugcaggucugagguuccgaugaacucuuuuuucucuccuuccccauuaaaaugggcagaagggaaggaacacuuggguuucaucaagcacauuguuauccuucggguuggcucugagaugauacguuugucacgguucauaaauuuuaucuuugcacuaaaaacaggguuagaauaucuucaaugcaauuauaaaaauguauuaaaacugagaaggagaaaaaauauggcgguagaugcgauuuuaaugauuguguaaauguucauuguuccauggcaaaaaaaaaaagucgagcuuuucagccacaguauuucagacaaaugccagggccuguuuuucuguaaauguguaccgugugcuuuuaacacaaagacaaauauguugcuuuaaaauuccgcuuggaauagagugaccagcugucguuauauaauaucugcaggcuaugauuguguaggugccuguagucacuggcuaugaaaauggccccaaauaaagugguauccacacuucuucuuucuccuacgaauuuggaggucuaggaacggggguaagccuauauggucauaauuagccugcaaacgugaauuaauaugcagaaucuguccccacugugauagaauuugccauucgcuuccuuugcuaaauggcuugcaguggcagcugacggccaaaggggaagcugagaacagcaaagauucaacugaaaacauuuuaggggguuccugacuucaggccucuuuucagaaugagggaauugucuaaaaucccaaaugcauucuuagcuaaggucagugugucugggucugugucaggcauguagcagccacagcaaacuucucuugagauagcaucuccuccccagcacucacuugacagauuguggucagucaacacucagucugauaguuuagaaagcuuuugcaaggcauuccccaauauaaccauuaagcaucaaacucucaaauggaaguuucgaaaaacagaaaaaaaaagugagcauaaaugcaaacuaucaccccauguaauaguuuauuuauuucaugcuccacuuuucugggcaguuuuguugucauucucucucuaccucuuuuuuuuuuuuuaaagacagagucucacucuguugcccaggcuggagugcaguggugcaaucuuggcucacugcagccuccaccucugccucccagguucaagugauacucaucucaagugguuucuaccucauuaaaacaaacaaacaaacaccacucaccauuuuuguggugggcaugguggcucaugccuguaaucccagcucuuugggaggccaacgcagguagauccccugagguugggaguuugagaccacccuggccaacauggugaaaucccaucucuacuaaaaauacaaaaauuagcugggugugguggcaugugcuauaaucccagcuacucaggaggcugaggcaggaaggucacuugaacccaggagguagagguugcaguaagcugauaucaugucaccgcacuccaaccugggugacaaggcuagacccuaucucaaaaauaaagaaacccuugcuauuuuagcuuccgaugaggauauuuauccuucuagcauuugaaugcagccaaaguccuuacugggcaaauuuuugagcucucaccccacauuaacaauuucucuccuuaacuuuguuucugaaugaaguuauccacagaguuuuaaagugaguggugaguuguggauaccucuuccgagcaggugcacccccauccugccauugucccucuccuuaguguauauggauugaugacauuucaguuucagacaaagggacauuucauuuuuuuuaggagauuaaagcuguguaagauauacaauuuaaacugaauguugauauuuuauagauuguugaguccgauuguccugaucuaaaauuaacugguuuugugauuugguguaaaucgcuuaaccucuuucaauguuuuuucagcaaaaugggguaagaacagaaucugccuugcagagaauuaaccgagaugauguguggaaagggccuaucccagaggcugguguaccaugguggcuucuccuggcucugcugguuauuauuauuagcauuauugucauugugaaagugacaaggaaugugccugugcgugaaucucacucuuagaucagacgugcuuuugaaauauccagauauauacaacacaaagagcgaaguuuguuuuauauuuuguuuguuuagguuuuuuuuuuuuuuuuuuuuuuggcugguguuuacugaaugcgugcaaggcuuucugucacaggcucuguguuaagauauuuaacggguguuucauuuucccagcaaugcuauaggacacagaaaggaacauaaauuguuacagagagaaagaggguaggucugugaauggaauugaacagguagguugaacaagauaaaugccgaggaagcaaguguauuuaaauaaacaguuguuuauggaaggcuuuggaaauccacuauauuaaucuggaauuuuaugaaauuuuaccagaacuuaaauuauuaauaguugaggacaaagaccaaccauuuuccccaaaacuuagucacuaguuuuguccuuaacaacuaauuaauaaauauuugugaauauagugagugacuaaaguaaugcauuaaugguugaauggcuggccaccgugccucaugccuguaaucccagcacuuugagaggccaaggcaggcagauuacuugaggucaggaguucaagaucagccugggcaauauggugaagccccgucucuacuaaaaauagagaaguuagccaggugugguggugggcgccuguaaucccagcuacaugggaggcugaagcaggagaauugcuugaacccaggagggacagguugcagugagacaagaugaugccauugcacuccagccugggucacagagcaagacuucaucugaaaaaaaaaaaaaaaaaaaaaaaaaaacaacaaacagaaaaaugaacgagugaguggcaagaaagaugaaaugauuuucaucaccaggccugccauggaauucauggugccuuguacuguggccaguaggugcaagaguaucuaguaggugcuuuauuuuuaaaaaaugucuuggaaucagucauaguuuaauaucaauuauauauaaauuagucuuucaggauccaacaguucugauuuauuccacucacacaacaagucaguucuuaacacaaaccacauagguucuuccuuaaauaaaaagcuguggcuaugaagaagugagaguuuuuuuuuuuuuccucuccaaaccaccacgugcucuuguguguuauuguaguggcuucgcagaguauuuauuuggccagaaagucuauagucaaauugcucuucauucucaaguguaguauuuauuucuccagcucaugcagaauucuguuuuauauggagguuuuaaauuugugcagaaaaguauuacguggguuucaaagguacucuuuuuucuuuuuugagacagggucucgcuguguugcccaugcuggagugcaguggugcgaucacagcuuucugcagcauugaccuugugggcucaagcagucguccugccucagccucccaaguagcuuagaaccacaggcauauaccaccauaccuggacauguuuuuaacuuuaauuuuuauuuuuguagagauguggucucccuauguugcccagguugcucucaaacuccuaggcucaagcagucuucccacccuggccucccaaagugcaggcauuuuaggcaugacccaucguguccagccuaaauggcauucuuggaaguaaaaccacaggggaucuguuggaaguggcaugauggaggaauuuuaaaagaauugaacaaauaaaauagucagagcucaaaaauugaguacugcuucguuucucccaaauaaccaucaccagacaaacaggugugugugugggugggggagguggccuggugguacuucaugaucuuggaagaaggaaggcgccccuccuucuuagcugauugaugaugagauagaaagauagaaacagccccaucacuaugagauggaaacacuucuuuccuucaucugacuucccucuccuucauucccaaccaaguuugaccccgccgcaguggagauuguggcagaugggucagauagcauguguccugucgcugucacaacuuuuuaauaagggcuggggguccucuugaagagcccaggaacugcagucccuccucuaugccuuccccugaacacagugcgcccucacuaauaaauucugagggcugacacugccugagccggcuggucuuugcccucaauuucauugagaugggccauugaaaacucauuacaagcuguuuagacucugacuuugacuuuugcucggcagcgaacaaaauuaacagcucuuggagguaggaaaaaaggcgcucagccaaauuaaaaaaaaaaaaaagaaagaaagaauugaaaugaugagaaaagacuuuuaauauuaacuccauuagucaugcaaacaagcgcacaugcgaagcgcauauguucugcguguggcucucauuuggagccugaugagaacugugguuucucccacuggagggaaauucauacccaggucuuacacguagcucaaaauguuuuacaugucaagcaaugagccuuugaguguagcagaauugcuucauaaauuuaacuaucacuuucaaauuucuguuuuuuuucuaauuuagugcuugauaguuuuuuaugugauaauuuuaaaaugcuguuuguagcaaaaguuaccuugauaguucaggugugcagagaaaauucacagccaucaauagaaaagaaaaaaaaauccuguuuauaccuuaggcauucugugauccuuaggauguagccaugacaguauuacggguuuuaaaagccacccaaguaaucuaaauuuccuccaaacuaacaauuccugaaagauugaaauauugcuaccaaugucuauggaugguuuccauugauauuugggaaguuuccauuuguauuugggaagcuuugcaugagcaaaaugccccuuucuccugauauuugcaacccaucuuaaaaauaaaaguacuuuucugcauguggucuuguacaugaaauuaagaauaucacuaccaaaauaucaaaauuuaaggacuagauugugaaauguuuaaggaggcaaagaauauuuaaccaagaaaggaaaaguguauuugagagagaccugaugaguucaccacugccucuggagaaucaaauccaaaacagcauauauauguauauuuuuuagagacggagucucacccugucgcccaggcucgagugcaguggcgccaucucaggaucucggcucacugcaagcuccgccucccggguucaugccauucuccugucucagccuccggaguagcugggacuacaggcacccgccaccucgccuggcuaauuuuuuuuuuuguauuguuuguauuuuucauauuuuucguagagucaggguuucacaguguuaugcaggauggucucgauuuccugacaucgugauccgcccgccucagccucccaaagugcugggauuacaggcgugagcugacgcucccggccuacagcauagauuugaggcaucuugaagguagaugcagaagagugggaucuacuuuggauuuuuagauuaaucacuguuaagacuuaaacagcuucuuauuugggugaaacaugggagugucaaaaauaagucacugucacucuuugccaacuuccuuuaacucuuuauacggcuauaucuccauagauauccaguuuuuguuuuguuuuuguuucuguuuucaguuccucuccaaacugucaaggacagugccaagaucugcgaauauagaaagauuaagaguuuuuuucugccuuguugggucuucuuucuagcaugccaggaacauuuuucucaucuuuugaacauuagggaauaacacccaaugccacccuauaaucucgagacagaaguggaggauccucuuaagacaagaaaucuuucaaagccaaauaaugaauuaauccaaagccacuugaggcucuagauagaucuuagcagucaaagcaauaaauauauaaucccauaaaucuaaacuuugugguauauucauuaggcugucuguuuucuuuucuuucaaauguuucacuuaauucccugauauaauaaggcuuccaaauucuugguguuuuucuacaaccaagaccuugaacuuuuuccucucaggauuucuuucaugagaacccauuuucuggccauuuggauaucauugaugagggaauugaagcauuucccuauucuuuagaguuucauuaaaguuugacuauauuccaguaacaauuguugcauaacaaaccacccccaaauuuaguggcuuaaaacaacaacauuuauuuuguucaggaaucuguaguuucagcagggcucugaggaacagcuugucucugcuccagcaucagcugaagcagcuugaaagccagggucugagaucaucugaagguuguucacucaugagucugaggauugaugcugacuggugggugggacccuugcuggagggucuauuggcuggaacaccuacacauugucuccauguacccugagcuuccucacaauauggcggcuggguuccaagggugagcgucccaagagaaagaaccaagcagaugcugcauugccuuuuauggccuuccauagaaguuacauagcccuagguuuuccugcauucuauuuuuuaggcugucagacccaccccaaccagguuugcagugagaggaaauagaccccaccucuucuggaagagaaugugggacuggacauacugccauggccacuuuugaaagaugcagucugccacauaagcaaacaguucguguccugcagugggauauugggaaaagaaugguauuuggcaaggggucaggaaaccugcuuuugaauccuaccucugccucuuacuagccacaugacugggucuuagcaugcucaucuaugaaaugggggacacuaaugcugaccccacauuugugcugaggauuaugcaaauaaaaucuguaauuugugcaagcauccaccaagugccuggugcagacuggaugcucaauaagucuuugguggguccauguauugaauuggaaucugcacauuauggccauuauuuagguuucuuguguccuaaucuaugucacugaguacauccuugcuguuuuucaugaauuuuccacugagucgcaacaugccacuggccagugaaggucaggcaggaaacagauuaacaacaucucauaccacaaugucaaaauacuuaaaaguguuuacagaugccagugacacccagugaaucuaaaacaagaggaccagagcagaaguaaaacuauucuuguucuucuaagcuugaacacaggccuugauguuuuaugauuguuuuaagguccauuaaucgcugaaucaugaggccauguaaaaaaaugacagcuauaacaucaagggcccggguuuauuuuaaauguuuuugcuucuacauggauucuaauuaacgacaguggcuaaaaccugauucaaauguggcaaauguggagugccaugggaugaagccagucaauuucaucuaggagcauuuuauggcuuauggaaagaaauauucucuuagauugaagggcgccagccuguaaugggcaucagcugauucucagaaagaagaaacaacguacuguuacauaauuggggcuucuccaaaguggccugaccaaacuguagagcugcuuguuugucugauacgguagccauuagccacauguggcuauuuaaacugaaaugaauuaaaguuguauaacauuuguaaaaaucacuucuucgguuucauuaacuagccucauuucaagugcucaguagcuacauguaccuaacacauuggacagcacgguuacagaacguuuucauuucaucggacaguuuaacugcuuuggagacugguucuccuuuuucuuuuuccauguucacuccagaauuaaagucaaccaguucaaaugucccaucuuuccccacagacauuugugcucaaaggcauccccuuccccauuuggagacucuccuagggccuaggcccaagcaaccaggacucccuguagucaaccccacuccucaauuuuuggcacccauguuauuccaccucaagaucauguccucuuuuaaccccucugaauaugcuccuccugugauacccauagggacccugaaccucuaguccucaagagcagucauucaccccuuuggacuauggauccguuugcaacccaggaacaacuacuguauggccacuucaaaccuguauaugcugcaaguauuuuauucuagguaggguaaauaauaggucuuagauauaggugcaaauaauuuucaaauauggguaaaugcuauugggauguguaaaguagaaauccauuuuaaaguguuauugaauccauacuaaccugaucauuacauauuuacuaauugaugauuacuaaaaauguggaccuuugugaauuuccgaugucauagaaggguguucuuaacuggaaaagucaguagccaacauucugggaaguagaggccucuuccucacugcuucauugguuuaaaauaaacuccaacagaaaaacaugccaucaucuuuaauuuccugcaucagcuaagcauuuauuucauguaguccucacacuagauugagugguuccauauuaauauccuacgucaaagaugaguaaauugagaugcguagguucuaauuugcccagugucguggugugugaucuugaccacuagccuaaacugcuauuuuauguccacccaucaaccucuacggcugccccucauuugaacacacaaaauauaguuguguggcuugguggagccaucuaaauuccguuaggccauuugccaaugcugcuauuaggggcgaaaugucaugcgcuugaucuaaauguacuuaggagaauucucaggaccugaugaauuauuauucggaauuuuauggccucacagguugcaggcuucauaccaacugcagcuaaugagcuaugggccccgagaaacacugaggacacacggcguucugcacacagagugggcuguuucugucuguucucccccugcacccuucucagaugcaaucucaagucauaggagaacuugugcaaauguuucuccuggaugguuuccuuuagagcauguguccuauaacuugaaaugguugucugagcagaauguuuuuagaaguuagauuuuuuuaggggggaaacaggaaccaaagcaaagccaauagagaucuugaaaaaaaaaaaaaaaaagaaaaaaccaccgugguauucuaggaagaaaaaagcauuuuucgaaugaaaacuuuuuauuauauuugauauauucugcuucccuucccuaguauguauuaaugagaugaaaucacuucuuaauuuucagguuaauauuaaaguugaagcccaucccucuacccugaggacucugccagccucuggcaguauuccuuuccaacuuccacuugccccaaauagguagaaguuagccuuuauuuuuggugucaugucuucuuucccuccuccuaucaguuuuucagaaacuccagaaauuuaaccuaguacacaggggccccccaccccuguuuccagaugccuucuagaaagaggacugggagugugaaugaggccaugugggcuuuguuugacccugugguugucaugacaauuucucaaagcuuagcugggacaggaagaaggaaggggaggauagcgguguguucagugugugagcuccuaaaagcucuugggucacuguucccaggggaugaugacccucuauggcagaucaguugcaugugcauaugagcuuucccuccucccguggguuagcauguuccacacucaccuucucaaagcaaagucucccuuaggggacccuugguauccuguucaucuggcaaaucucagcaccaauagaaacaccaagaacauggauucaucaaaggaaaaauguugaaguuuccauuuuuaugcuuccugguaauccuucagcccuugauggaaauuuccagaccuaaaccagugaauuaagaguauggggaagaggagcccucauacaguucuguuaaaugguccuuuaauauucuucuucagagugacggguaccccuugccuauacauuuucaaaacuacacugaaaauuucaaaacauuucuaucagaacacagucuuauucucagcugaucugcaauuuccaccuggaucuguuaaauggcagcuuagcuaugaaauaucauguucugcccaaucaccuacccugccucauaugaucagccgguauauuuauguggacacaugcagccacacuuguuuuuaacauuugagaaugacagcguauuggcaguucauauaagcuaucaaauauuacaugucaacucagaaaacaucccuaggaaguauuaugggaacccccuguaucacuugagauucuuggauccauauuugcuguuaacaaaauaaauuaauagucaacaacugauuaaagcauuucccugcuaccaugauugccuugacaaauucugcagugcuggaguauuuuaccucccauuauuucuuccgcugaacaggacguuugguucuaauuguuaagccugccuaaugcugauugaagcgggccauaguaucaaggguggaagaaggugggaauauaaacuagauuugcucccuucuguaggaauaacucuaugaagacuuucuuuuuggagacaaaucaucuuaugcaggggggaaaaaaaacucccuaaaaaagacaaaugacagcgcaagauccaaaaagacaagugcucagucauuuugucauaaugccagaagagacaguaaugcuguguggacuaugcauucagacauuuagaaaauacugcaggcagagcuggggauuccguggccagaagcauauuuggugaaccgaggacgcaucaaagagcuucucugguguuuaguaacuugcacuguauuucagagguuuauaaagggaagggacaggaaagcagugugccaguaagacaacuccucuucucgucuggauuuuagaggaaugcagugaacaaaugaugaaaaagucugaagggacuuugguaauucaguauccgaaaaacaaucaguguuuugugacauucuuaguugugaucuaccuuauguuguauacacauggucacucacauacauagguguauuauucugcaauugcugaguaauugaugauccuucauucucucugugauucauaggcucucuggguuggauaaaucacuucggggaauuauaucuacuaguauauuuaugucacuagaauuccuuugagaagcuaucacuguguacauuuacuguaucuauuaacuuucuucaucucccucuuccucccuuucuuccuuuccuuucccuuuccuuucuccucuccuguccuuucucucucccucccucuuucuuuucuuucuuuuuccuuuuucucucucucuuucccccuuuuuguauuucuaggagaaacgggguuucaccauguuggccaggcuggucucaagcuccugaccucaggugauccaccugccucagucucccaaagugcugggauuacaggcaugagccaucaugcccagcccccuuguccucuucuuauaaggcuacuaauccccucaugaggggacccauccucaagacuucaucuaaaccuaacaaccucuccagggucccacacccagauaccaucccacugauggucagggcuuugacauaugaaugagggguagagggacacaaacauucagucccuaacacuuggucaaguuacuuaagcuugguaagccucucucuucuuacugagucaugagcauaauaagauauaccuguuaggguucuuuugaggaauaaauggaauuuuuaaagaauugugccagacauguaauaauuacuugauaaacuauagcuauuauaacaccaucaaagcugugguucuuacccucaucauuguuuacccucucacacaguaagaucuuucugaaaaggaucaagucucauucucuuuugaaccccaaaguccccagccaccacagagaccaaauacaguagguaccaaugcauggcaaugcauaggaacuagguguccuaacuuggcacuguaucugccaauuuuuuaaaagacaagaugacaucccaaagauuggggcauauuuaggauaaugccccauucugugaggguggacauuauagaggacaucagcagccagccacaggccaucucuuggugccauuggguuuugagacccucagggugacaccgauuuaacaugacaggucuuauguucuuggguaaugucaaacaacuucuugaaaauauuuguuaaaaaaaacccaaaaacagaaacauaucugacugggcaugguggcuccugccuguaauccugacacuuugggaggccgagguggacggaucaccugaggucaggaguucgagaccagccuggccaacauggcgaaacuccuucucuacuaaaaauaaaaaaaaaaaauugccaggccuaggcgcaggcaccuguaaucccagcugcucgggaggcugacgcgcgagaaucacuugaacccaggaggcgaagguugcagugagccaagauagugccacugcacugcagccugggugacagaaugagacuccauccucccacccccuaaaaaaaaaaucuauccaaaggccuugacuaaugcagaaucagcacuaauuuacaagccccauaaacuaaagaccccauguuuguguuauaaguuuucaaacuuuuuaaauauuuuccccugucuuauuuucuaucauuucacaucuucuuaaacacauauauuuuuaaaagagguuuugacucacuggugaauuugucuuaaaauggaaaaauaaaaucaaauauaagaauuuuguuaugaaucuuuggggaaacacaauuagggaaucuaccuuaauagguaaacccauguaauuucuuauuuccgucuaguuauaggaaaauacugagauacuugugagauguuuucuuuuuuuuuuuuuccaacuuguauacacguuguucuauaagugguugauuguuuuuuaggaaaaaaaaauucagcaucucaaauguaccuuuaauauugcuucugauuuuuguuguuuugcuaucauagcguuaccuaccucacagagauguuuuaggucauaaguauuuuucauuuaauuuuuuuuccccuuaauuuccuuuuuuucccuccuaagcuauaaauauacagccuuaaaaaaaacacucagaaauuuaaguccaagaagccugcuuuucuugauaccuuucaagugcuagauuaauaacauuuuugucaggugguuaccagaauggaggauacuugagcugaguuuugcuagaguccaagaucaucuauucuaauuucuggggacacauauuuuguccugguuagagagauauauaaugaugccuaucugauucugugguggucuggcuuugauguauguauaugugggcaggaaugugugugcgugugugugugcaugugugagcuccuguguguguguucaucacguauccauugugucuccaaggucuuaucaacagcaacaaaaggccuccuuugagaucaaucacauucauucgauguuuguuuucuacuaccugauacuuacugcuuucucuuugucgccguuaauuuuguuugucauaugucagaccaggaugaguggggcacauacagauucagcucauuuuauuuuuuuucucccuuccuucgucaccaccuuugcuaauuucaggcggucagcacauuuagcaagcauguagcugcuugccugagcaagccauuaaucuauauuagaaaauguagaggccccaguguuaaccuuccugaagcuugucuccccacccccaauucuauagguucuauuauaucuccgcugguuuaaggcaacugcuguuucuuuuaggaguuuucuuuucuuuccuugcugaauaucugcacuuaccaauacugcccaggcacaugggcuguggcucaaguuuucagugcaggacagugugucauugcaggagaagacagaacccggccagauccucccgcugccggcaagcggagucaguuacugggaagccauaauaauucugucuucuagagaauuuuggcaaaaaugugccuccaucuuacaucaacaauuuuucaucuuucuggaauuuuuauuuccccuuccccucuuguuccuuuuuauccuccuggugaaguaucuccuuuucccuaaaaaacuggaaaaaaugcacuuuucuauauuaauucaaaucauauucaaaaaauacuauauguuaaaaaauacgauguuucuguaauccuuacauccccuaauaaaaccacugugugaugaaacuaccaagaagccucucuugaaaaaaaaaaaauuaagugaaccucuacuuuagaauguuggcuuuucauauauguacaaaacaaaagagguugcagugauggcguggauaaaggcaccuguguacuuuuccaaccuauccaauuucaagauguauccuuuguggauuacauugguucuuuucuauggaaucaugcaccuuagaccugggagaaaccagcgugacauccagggucaagguuuuccaaucagguauuuugggggaaaaaguucugccuucauguaacaacuaaugugacauggcaguguauaagacauuacagccaaggccuucugguugaaguuggggaacugugggcguuguccccacuaguccugucaucugcccuugcaaaaccacccuugggcucucucgcgugcggucugugcaccagcuaccuuugugcuccccacauucuuccaccuggccuggaagcugaccauaguuggcucucuugcccuuucuucuucugguuggauuuagcaauuuaauuuucaggcuugcucccugcagggugucacuucaccaccuuccucuguagaagguuucguccaggccgggcacaguggcucacgccuguaaucccaacacuucgggaggccgaggugggcagauugucugaggucaggaguuugaaaccagccuggccaacauagugaaaacccaucucuacuaaaaauacaaaaauuaaccaggcaugguggcacacaccuguaaucccagcuacuugggagguugagacaggagauuuccuuaagccucggagauggagguugcagugagccaagauugugccacugcacuccagccuggcugagagaaugaaacucugucucgagaaaaaaaaaaaaaaagaagguuucauacauuuuagcugacaagggcaggagcuguuccugcuguuacuaacuggaguacauugcaugaaaccuugcuguuuccuuaaacccugcaccgaccuuuacaaacagugccuuuacuaaacacuucuuacguuacccguuuugaguguaccaucugccucuugccaggacccugaccaagaauuugaaaucucagaccaugaugaccuccuugcccaaugcguaagcuguccuccaaaacacacauuuaugggggcagagggagucucucuggaaggaaacuucgucugagccauggcuccuuuugcuuccccuggguuuuaauccuuccuucccuuccuguucuuuuaaggaaaucugaaaaggagcaaaagagcuuuagaacugcaaugcaucugucugaggccaaggacaguuguacgcagaccucucugccaguguuucagugacccuccucuugcugcuuggcugccuaugaguccaugcugacaucuggcucugucugcccaaauauaaacuugagagugacuuccaagauauauacagggcucagagguucucuccccaacccauucacuggcccugcucucucucgauguucccaagucuccugggugaccuuguguguccuuccugggauauugcucaaucacccuagaacuguaaggccaaguggucauagccagaacauggcagaaacauuccugcuucuauucugcuuuucuagcauggaauccccucugccuuaaugugaauaaauacuccccaaaaugaaggcagaauccaguaucuguuguuuaaacuaaaucccuaacuggacccccucugauaaacccucugauaaagaauugauguaaaauuugggacgcuggauaggaccaggaagccagagaaagagggcacccuuuucuuuucuagcauuugaguucccaaagaaguaaaacucugugaauguucacuucauuuuuuccugauauaucgaggacuccagauguaaccucauugauagucuugguguguucuucaguauuugugcuuuuaauagauauugcaaguguguuuaaugugaaaauagaaauggagggcuuuuaaaagagcuuacucaaaauccugccaauuacugaaaucuaccagacaagaaggagccacucuuuuuuuuuuuuuuuuuuuuuuuuuuuuuugauacaaugaggggaaauguuucuuccacaaaagccuggccguuugucuuuaaaaauuuucaucuuuuggguacugaguuguaauaguaaauacagauguagcugugucacauuaaaagcacaaccaaauuguaguacaauguucaggacacuuuuaugucacuuuaaaauguagaguaucaucuaaaaaugagcaauugcugugaagaaacugggguuggcucugauuuuguggcucaguuuuuuuugguuucuugagaagaucaucuuuaagucaaaaguuaugcaaugccaaguacucaucuguguaaucuauuucaguuuccaaaauuuuucaucaccugguuacaaacaucugaaggcaagaaauagccaagauuccauugcaagucccagaguaaguuauuauuagacagaaacaaacaaguaaauaccuugggccugagcuauugcccaaaccaguccugacuuggcuuggguucugaccaacuguuuuugaucccacagucugaaguacguuuguggaaauacaaaggucaaaccuuccccuaacccucuguaaucccugguggagcuaaggaaugaaaaguugcuuaaacauuuuccuguugccaguuuuucuuaaacauuagugcuauucuuuuuuuuuuuuuuuuuuuuuuuuuuuccuucuucaacccugacucugauucacaaagaauagggaagcuuagccaacugcaguuucaaaguauugcuucuuaagccugggccaaguguguagacuugauagaauucugauuaaugcaucuuauuacauuaauuuuagaagaaaccagaaggcauuucuccuauuccuagugcaggccagccugccagaagcauuugccuccuuaaagagcuaauaucuucagcuaccaacaaucauaaaacugaaagaucuaucggaagaguuggcuucucuggaugugcauaaggcacacugcaaaauagauguacagcuuggcugaacuuugcuucaaauuugccaaucaaaauucacgaacccaugccaaguuggcuacaaaaccucucgcuuggagccagcacuaauuaugucaacaaguaguucaaguuuagccccuguuaaguccuguacuccuggguauuggggaugagucuuugugugguggcaaacgggcccugucuucgcuuggcuuccuccuaaaauucccaggaccucuucgggucccagcccuuucucuuccccugagauugcgccuccucacccucugucuuggauggaaagaguuccaaggcaguccagucaccccagugaaaaguuuucugaugaggucaagccuucuuauugucauaggucauuuucuuuagaaaugagaaaccaucucauugggcuuuccaggaaggagacucugagugcaaguuuguugugaagaacacgugccuuggaauuaacaccuauggaagggaagaaaacgaagauggagugggcagagggagaagcugacugagauggaguccagcaagggucucagucaaccuuaugaagcuaaaagggcccaucagagcuaaucccuauugggcuaauguggccaggcuuuuauaaaccugccuugacucgugauugggugggcugccccaggaaggaugugcccuugcagaagguagucucuguguucagguacucccuggaaaggcuaauggcugaaggcuacagguuacccuggaagggagaccugggcugcacaucagagcccaucuacuuuccaguguggacaaguuccagcuccugccccagcccugccacaccaucacccucuccagcacacacagcccuucucuguugauuaggguugguugagcuguucuaccaccuucauugacucaggccuugaagugcaguagaaagcccuaggacaaggcaggcccaguuuugaggcugggugcagaggcucaugccuguaaucccagcacuucgggaggccacggcaagaggaucacuugaagccaggaguuugagaucagucuggccaacacagcgagacccaaucucuccaaaaaguuuaaaaaucggcugggcauggugguacaugccuguaguccuagcuacucaggagacugaggcaggaggaucacuugagccucguaggucgaggcugcagugaacuaagaugccacaggacuauagccugggcaguuuugagugcugccucuaccauguaacuagcuugccagucaagucauuaacuauucggggccuuaguuucgucuuuucugaauuggagccaguauacguaauuccaaagguugcuuuuaagcguaagugagaauauuggcagaaauucguuagcacugagagagggaauguaaaguggagguuaaguguacggcuuaagagcagagucaggaaaccuagacuugcacccugauuucugaguugaauguuccaggguaagccacuuaaucucucuaauccucauugugcuuagcucuagaauggaggcuuguugagaaaauuaaauggaaacgauaacggcgaagcacuuagcacaugagcaggcccauaguacucagguguucauuccacagaaaagcguucacucuucugcacucuuucucagucaguuggccacugcuguucaguucacuucuuuuggaucuucucagccccaucagguucccaggugaaaugagccccggcucagcaggccaguugucuucagugacccccagugaggcagcaggugggacuugauucuggaggcaagacucaacuccauagacagggcuuacacaccggaccaaauugaggacuagcuaaaacagggauagggugggugcaccuuuccaugagcuguguccgccagugugucaugucaguuuacaauuuccauggcaacaccuagaaguuacugccccuuuccaugacaaugacccaacaaccuggaaguuaccacccuuuuucuagaaauuucugcauaauccaccacuuaauuugcauauaauuaaaaauggguguaaaugugauggcagaacugccucggaauugccacuguggguacucugcaugugggguagcccuguuuugcaaggagcagcaccucugcuccuguuguacacugucccuucaauaaaaguugcuaacaccaccaccuugcccuugaauucuuuccugggcaaagccaagaacccuguuggccuaagccgcaauucugggguucgccugcccugcaucaccagcacaguggaaggccacaagcucacagcauuuucauccguaaacaaagcuuggcaauaucucugaugguuaagagcuuacguguuugcgccagugagacuugcacucagucuucuuugagugagacuugaacucgauucugagucuccuccuuccuagauggacucauuauuuacuuauuuauguauucacucaucuauucauuaauuuauacucuuaguuugauaucaacaucuguaaaauggggaugguaauguggugauauggaggaaaauaaaauaacucuggcauuguucuuacuauuuaccucuguacugucaucguuaucauuccuuugauaaccgugagcaccugucaugggccuggcacucuaguaggcucucaggaugcacaaugacccugucccugcuugcuggagacauaggagaagcccccagccacugacaucuggguguuguaagaaagcaagaacagucauggacacugcuaaguuuugaugccaaagagccaaauuugcaguaccagaauguccuuuccaugugugacccaaaguuuuggcuacugaagacguugcaugcccuccaacaguggaaguggugcccugaauacgccagaaauaaucguggagucaacgaagaucugggaguauuguuuggagacaucucaguauuccuaauucauuuucccauccuuaaauaaaaaucuuucuuacugaugaucugagaacuucuuguaagccccauuuccaugaguagaguuggccauugcccacuaagaaaauuuaggugguuuuuauugggauuaguggaugaacuuaggauuaguguggcccuuccuugaaauauaaugacaaccuuggugaaagcaagaccacagggccugucuucagggaagugccuugcauuuuaauaccaaccaugccacguguauguguuuccugggccugccauaacaaauuaucgcaaacuggguagauugagaaucauucauuguuucaugguuuugguggccggaaguccaaaaucaaggcguuugugggguucguuccuucuggaagcuaugagggagaaaccaugccaugccugucuccugguuucuggugacugcuggcaauucuugaugucccuuggcuuggaaacaccacauucuaaucucuacuuccucccuuacaucaccuucuccucuggcuuuguguccuuucugucucuuacaaggacaccagucauuggacuuaggacccaccuaauugaguaugaucucaucucauuccuuaucuuaauuacauuugcaaagacccuguuuccaaauaaagucacauucguugguucugagugaacauguuucuagggggacacuauugaacccacugcacugcaucaaacguaugggugugcuuucucuuggccuuucuccuauuugccuucucuguguugggaauuguggcuucacacccaucuacuuaucccugcauguugagcaucgucuguuaccugaagagcagaaggaugauaaaagugaggaaacugaggcacaggcuugccccagguuacacagcuaguuaugauggagggugggucggaagccaagcgccccccagcccccaccccacaacagguguauguggccucugguuuauccuucuuucccccugcucaccacauggcuucucauuuugaaaacccgguggcuaauaaaguagaugaguuucaggauugcaaaauauugugauccuggccuuuguccauuguguaaucuucacagugaccagaguguuugcaguuccuaggaaguucacccauucccaacagugucccagggucaagcucagaugaccugugguauuuuuauacccauauaugugucaauguuuauaacuuuuaaaguuguuuucaggaagcacugaggcauguggucguucacaggugacaaagacagaggcucagggaacucaguugguugcugagcuuuaaacccaagucuauuucugaggcuggacugagucuuugagaaaaugcaaaguaaccuagcauagugucagacacaaaauagucagcaaauaccaucguagauucaggcuucugaguccaaagcuaacaauucucaucuccaauucccaucuucaaauauuaaaauaaacuuuuuuuuuaagagacagaaucucacuguguugcucaggcuagagugcuguggcaucuuagcucacagcagccucgaccuaccaggcucaagcgauccuucugccucagucuccugaguagguaggacuauaggcaugcaccaccaugcccagcuauuuuuaaaauuuccuguagagauggggucucagugcauuggccagacugaccuaaacuccuggcuacaagugauccucuugccuuggccucccaaagugcugggauuacaggugugagccaccaugcccagccuuaaauaaacucuuuagugucaaaaaaucuacgugaggccaggugugguggcuuaccccuguaaucacagcacuuuaggaggccaaggugggugggucaucugaggucaggaguucaagcccagccuggcugacaugacgaaacgccaucucuacuaaaaacacaaaaauuagccaggugugguggcaugugccuguaaucuuagcuacucaagaggcugaggcaggagaauggcuugaacccaggaggcagggguugcagucagcugagacugcgccaguguacuccagccugagagacagagccgagacucugucucaaagaaaaacaaaaacaaaaacaaacaaaaaucuacuugaaccaauaaaaauucccauccccaccuagaauucuaaauauuuuauaaauaaagucuucagagccuagauauucacuagaacccaguggucacguguuccuaauggguggaauauuauuuugaaucuuuccaugaugagaguuacauugcugggugaaagcuuuuuaugcaacaucaucauuguugaauaaacagacgcuuagcauauuuagguuggaaugcaagggaacuaaagguaggggagauucuuaaggaagucuacuuucucuucaagaaugcuaucaaauugaaagguaauuccuaaagaagagucauuuguaaauuagggaggaagagcuaaaaaagauuccuagcaagaaacaucauaaaggggcuugauaaagccaaaaaacuaaaagaaaaaaaaaaaggaauuagaaacagagaaaagaggcuucguguuguuuguaaauuugugaauaaaucuguuaaagaaauauuggauucauauucaacuuggaaaacagggaaaggccuuuuauugcaugcuuugaaguuugaauacacuuucaguagcucuucguuaucucaaauuaaaucuuaaauugagcuugugguucugugaauuaauacuccggccuuucagcccugcugcugaggucauucaaaucuaaugguggaaacggucacagggucaggccuuggauggugcuguauagaaaugccuuaaugaugcuggcagauguuugcauucugcagcuggggcggcuggcggguugggggcugcaggaagagaggaguugaugaucacauuauugugucagccgccugugugaauaaggaaggacagacucccaccccaucccaucauuccagguucaauaagaggcaggugcuuccuaaagcagaaaaauguaagggaagucaucaucgcuuaucaucaccugaauguucaccauggugacccacaucucaggaugcugcaaaacgagagaggucaccugucuguguaaucgcauauagcauucuaaagauguuccauucauucagcaaauguuuaauaaaggcuucaucugaaguuuaauggacauuguuugauaaaacagacccagucacuggugucagggaguuuauauaaaaguauacacguaucugugcaaaugugugcauuuaaggcccgccgagccugagcugauaugcaugucuuaacuuugcuguuucucuaaggggauggaaggauuggcuacccugagcuuucuagacuuguuauuuuuuuuuuuuuaagacagaaucuuguucugucuccgagcuagaguacaaugguaugaucauagcucacuacaaccuccaaugccuggguuuaagugauccugccaccucagccucccaaguagcuaggacuacaggcgagagccaccauacugggcuaauuuuuguuuuuuauugagauggggucuuccuauguugcccagccuggucucaaacuucuggccucaaagcaauccuccugccuugauagacguguucauuguagguuucuagccucugaauccaaauuuuauuuuucuaguacuuuauuuuauuuuacuuuuuauugauugaaaccuugaaauaaaguuuuuaaaaaucuauuugauuuuaaacgaucuuuagaaauauaugaagguuaaaaauaacucucauuuugcuuuuuauaaacaguccacuccuacauguagacacauuuagaugcuucauuuugccuguagaaaguuuuucuaacaauaaacugaccaaugaugaugaaauuuuuauugacucaaaugugugauugguugauuuacuguauucaguccaagcuccucccaaagguuagcucauugacucuacaacucuguuuuccucauucauucauuccucuaaucaauauguauugcucacuugguacaugucagauacuuuccuaggugcuggggagaaacaagcaaaguacuucagggccuguauuaguuuguuuuucacgcugcugauaaagacacacccgagacugggaagaaaaagagguuuaauuggacuuacaguuccgcacggcuggggaggccucagaaucauggcaggaggugaaaggcacuucuuacacggcagcggcaagagaaaaugaggaagaagcgcacgugagaaccccugguaaacccaucagaucuugugacacuuauucacuaucacgaggauagcgcaggaaagaccggcccacaugauugaguuaccucgcccugggucccucccacaacaugugggaauucugggagauacaauucaaguugagauuuggguggagacacacccaaagcauaucaggguccuaggcaacuuugugugagaacagaacagagaggaagcgacacaccuuuccuuugggagcaauuuuuggguugcuuuuguuuuuauuuguuguuuucauuccugguaguaauaguaacaguagaaaauggcagcguuauagccauaaacaaagugcucugugguuucucucucaccauccccuaaacccuacaaggcuaggggaaaaugguaauacucaugaacaacuccacuucauaaaugaggaugccggcacucggggaggucaagugaguuucauaaggucauagagcaaccaaguggcagggcugacucccacccagguguguuccaugggcagcgucuucuuacugcacuguccugacuugcucuagugagaucuaagagaggcacaaucugcuuuccuuuugauggugugcagcagcaugauggccgcgcgaauuuccaagaagaggauguuggucgcugauggcaucuucaaagcugaacggaaucaguuucuuacuccggagcuggcuaaagacgcuucucugaagcucagguucaaguuacacccaucacgacaguaacaaauaucuuagccaacagaacaaaaaauguuccuggugagaacagccagggauucuggaauugacugcuguaguucagaagagauuuggcuucccacagggcauuguagagcuuuaugcugaaaagguggccccagaggucugugugccauugcccaggucgagucugcaguacaaacuccuaggagggcuuacugugcggagggccugcgauggugggcugugguucaucaugaauaggggggccauaggcugccaagcugugguuucugggagacucugaggacagagggucaaauccaugaguuuguggauggccugaugauccccagcggagaccauguuaacuaguacauugaugcuguugugugccaugugcugcucagauaggguuuucugggcaucaaggugaaggucaugcugcccugggaccccgcugguaagacuggcccuaagaagccucugccugaccacgugagcaucauggaacccaaagaugagguagugcccaccacucccaucucagaacagaagggugggaagccagagccgccugcuaugccccagccaguccccauagcauaacgggcuguccuuggcaguuguauucggagucuggauguugcuuuguaaagacauuuaauaaaauauuguacaaagacaaccgggaaugccuguaaucccagcacugugggagucaagacaggccgaucacuugaggucaagaguucaagaccagucuggccaacauggugaaacccugucucuacuaaaaauacaaagauuagccuggcgugcccuguaaucacagcuacuugggaggcugaggcaggagaaucgcuugaacccgggagguggagguugcagugagccaagaucgugccauugcacuccagccugggcaaaaagaguaaaacucagucucaaaacaacagcaacagaaauguauucucucacaguucuggaggccagacauucagaaucaaggcagggcuauacuuacuuuggaggcucuagcuaagaaucuguuccuugcaucuuucguuucugguggcugcucgugauugugggcugugaccauaucacuccaaucccugccucugcagccacauggccuucuccucuucuccuguguuccuuuccugucugccucaaaucucccucuaccuuucugcuaugaagacacuuguuuuuggauuuagggucuuccuggcugaucucaugucaagauccguaacuuaauuacaucugcaaagaccugauucccaauaagcuugccuucacaaguugcagggauuuggauauggaacugccuuuuuggaggccaccauucaacccacaauaagagcacaguggugagguuugaggggugguaugaggucacagucacagccaccccucucaccagcugugugacaauucuggauuuacuuagcuguccucugccuccaucucccuuucccuguaaguggaagugguauucauugaucacacacuacaugccggacaccaagcuauuacauuuuuugaauauguuucuuccuugccucuugaggacuaaccagccggguuuagauuauuuccuccccgugucgcuuuccugcccccacauguuauagauggugcaagggaaccagagagcuuugaucccugguuucucuggucacaaaccugcucuccucuccagaacuccaggaugccuuucugugggggcuaaaucaaauuuagcuguucccccaacugcaaaguacauaggcaucaagugaaaggguaaaugcaugaaaaccugaauggcugauccucuaagacagugagagcagauguuaauugcucacuguccaagugcugggcucugugauaagagcuucacgcagaugacaucaaagcaccaugugugggggaagcacgaugaucuugaccauuuuacagaugaggaagguaaggcucggugucaucaacucacagaggaaguggagcuggagucucuguggcuccagggucagguguguagucucgaaggcuguuuucuguucugcaaguuucuccuuaacacauuuccagccccauuuucuggcagggagaccccaggacugaaaggagcuggaagagugaggucuaagagaaaaaggggcugggugugguagcucaugccuguaaucccagcacuuugggaggccaaggugggugggucaccugaggucaggacuucgagaccagccuggccaacauggugaaaccccaucucuacuaaaaauaaaaaaaaaaaaaaauuagccaggcaugguggugcaugucuguuaucccagcuacuugggaggcuaaggcaggagaaucacuugaaucugggaggcagcgguugcagugagccgagauggcgccacugcacucuagccugggcggcaagcaagacaccauuucagagaaaaacaacaacaacaaaacauauggccagcagccaguguuguuaucucaggaugggaaccaggcacugcaccuccucauuaggagucagaguaagggggcuaagcugguugacaugacuggggacagaguugcuguugaaauugucagguuaugaagggaaauuagcugcugggugucaagaggugcacauugcugcaggcauuggcaacugggagcccuggugugucuauuagcuccucaggcugugaggccuuaaugacaccccugccaacauuacaggaggcagcaagugacaguaggaaugagagaggccagcuaaucuaaucuguacgccccacaggaguugggggcugaggacuucaagaccuggcuucugcucccugucacaguggcaaagacaaugacaauaaaagcacagccuccagagagaagagccuucgauggaccuggguguuaauccaggggccaggcaaaaacugggggaugcagaauaggagguugggcuggaggugagugagaagaacggauacgguuaggaccaacauuuaggcaauaugaccguguacaggauucuaccaccaucgucaccaucaguguuacuguucccugccaucugccuguggggugucuaccaucuaaaguccagcacugcacugggcauuuuuaaauuaucauuaguauauaauuauauauaauaauaauuuaauuuauaacuauaucauuuauuaagguccuacuauauaccaaauucuaucggacacauguccuaauaauaaacgugauauaaucuaucauuauuuacaaaacuucacacucugaccuuuauuaauuaugugugugccaauuaugugcagggaacuguauuaaucguaguuagcaauaucgucucuaguccuccaacccuauaaagugggcacaauuauuauuucucuauugcaauugccauuuagccucagcuggauuggaaacuauguaauggagacucucaggccacugucuuuugagcagcauuuucugcauugcauucuuguauguaauccuaaaauguagauguaguuuucccccuuuuagagauaagguaaucaaaacuuauagagguuaaagggacuugccaaagcgacacagccaugaauggcaaagcuaggauuuaaacccuuggacuucuucuccuugccauuccaccccaucauaaauucuaaacaucauaagcagaaccaucauaagucaggguccaucuggaagauggauggauggauggauggauggauggauggauggauggauggagagagagagagacagauaggcagacagauagcuagacagauggacagauagagauuuuuaggaacuggcgaauuggcucacacaauuauggaagcccagaagucccaagaaguguagccagcaaucuggagauccagaagggcccaugguagaaaccucauccaaaggcagaagacaagcaucccagguugaagacagucaggcaaagagagaaaauuauuucuuacucagacuuuuguuuuauucgggccuucaacagauuagaugagauccaccccuacagggcagggcaaucaguuuuacucagucuacugauucaaagguuagucucauguagaaucacccucacagacacacacucagaaauaaugguuagucagauaucugggcacuguguggcccagucaaguugacaccuacaauuuuuuuuuugccuucuuuuuauuuuugguguugucauccuguguccaaggcacauauagucaaucaucacaccuuucccuuagccuguacuagguucugugccaaggauuuuagaaagucaugucucauucaguuccccuaacaggucuaggagucauuaucuuccccaaccuaaggaaacugagacccagagauucagaguaucccaagauccuacaggaauugcagauuguagccaaaauuggaacuccuaauuccagagcuccucccuccugcuagcauuuuucuuugaguaguuuuauuaaugagaaaagcuguugagcaccagagcaaccccgccucuucuaaauaccaucugacauauacauucagcagaggaaaaaugaugugaggucuggggcuugcuuuaaaauacuuuggggccagacacaguggcucacaccuguaagcccagugcuuugggagucugaagugguaggaucacuagaggucaggaguucaagaccagccuggguaacauaguaacauagggagacccucaucucuauaaaaaauuuacaugaaaaaaaauaaacaaaauacuucugcaacagcagcagcaagagcugccgcaaugaaagaagaaagaaaaggagggagaggaugaaggaaagaagcaguguuaacauucuaguaauauuugcaucugaaugauauuuauaugggguuauuguccucccuuuguguauguuuaaaauuuucauaauaagcauauuuauauauauacacauaaaacauauauguacauauuaucauaaugccuaccugcucuugagaaaguagugccguauggcuggggguuuuucucacugguuucuauggcucuccccucccccacuuuuucuaagaagugguaguaccuaucugacuauuuucuuggcugccugaagaggccucaaaauuagaguaaacaaauuacccauuaccagggaagccuccuuccucccagcagauucccagcaucuucuuucaccucuaggagauauuuuccaaggucacuaaauuaagccuucagacaaucgaaaaauugaaucucaguaccucuauuuuccuaacaaaauuucugcagcaccgauuggggcugacagguacggccgugcagcuuucugggcuguucaggucgauuuggccaagcaggacggcaucagcuuguauuggagggaacaucugagcagcucagggcccccugggagucagagcguucccucccuccuugccacuguaaaugacuauuucugucguuugcagaguguccuuuucuuucuccuacagccccauccuuacccucuauagccaucaggucaggugcgucuucuucauuuauuuaucaaaagggccauagcaaucauugcaaacauguuuaggaggauuuggaaaccauguucuuuuaaagggcacuaaugaugcagcaguaaucacagugcuaguggaaggggagggcagaaugugauguuuugggagugaauucuguaagagaagaagggacugcguuccuagcccuccagagcuugcagcuaucacagccuggcugguggaggggcuugcagagcugagaaccacucagaauuugggggcugaagacccuggcugucugagcaccaucucugugacuuucgaggucauguuuucccuccagcccucauuucccccuuuauaagcugugucuuagcuagugcuuucagcaaagaauaucuuuaggcuccuggaggauugauauccccugaaguagccccugaccagccuccaagauguauccuaaaagcuccuauggaaguuuacauuucacucaaaauaucuguguucauguaaauguaaaaaugaugucuuaagaugcuuagcagugaauaaaaugggugcucuagggagaugcagugaguuuauccuguggcuuugaguauacacugguacccuacgugggagaccccggugcccaugcccgggugcacaaagccagcaucagugaccugcacaccaggaggcaggcugcaugaugauugggugcaaguccuuaggugggucacucagucuuucuuuucuugaguuuuuucaucugugaaagagugaucauaauacuauuuccauugagaagaagaaauaauuuauguaaagcacaaagcauaaucccugguauucaauaaguacucaguaaauacuagugaaaauaaugauuauaacuaugaccuccagaagcuuuuacugagcaucuaucuguagcacugcaugucaagccaagcuagaguacagucucuuaggagacacaggggaggaaaacauccuuggcagguucgcauauuggugaucucgucguaauuuucucaaauacccuuccucuuuccucacuuuuggugauaacuaccuguguugcucuugucacuuuugccuggauccacuaacucacuaccuagguaucugcaacaguuauccauugcugccuaacaaauuaccccaaaauguaagcacuuagaaucucauugucuuugugggucaggaauuagggaguggcuuagcugggugauucuagcucagggucuuuucugaaguugccagcaagcuguuggcuggggcugcagucucagaauccuugacugaaggggagguuucguguccaaggggcucacugauguggcuuuuagcaggaggccucaguucuucaccaugggggccucucuguacagcuucaggagcagccucacaauaugucaucuggucucccacagagugaugaucucagagagagugugaggaagauguggcauggccuuuuaagccccauucuuagacaucaugcacugucaagcaccguaacuuuagcuacauucuauugauuagaagaauacuaguaaagaccauaguuaggagaggggaaccuggcuccaccauuggaagggaggucuaucaaagaacuugugggcauauucuaagaccaccacacucugccacuccacacacccugacucuccuaacaccugcucgcuucacugguucggcuauuggcaguggcauggagugugggaaaaugcgucccucucuccuuccuggauuagaaaagucaucauccugcuagugugaauccauguccugugguggcccucucaggagggauugugauuaaagaauggacaacccaagggaaucaugugucaugguggagcauacaggccagcaggugaguuggggaggcgccuuuacagaggaaaccuugagcuucuucugugauauucauuacagaacuucccccaaagacagaugacauccauuuauaauuauuucaccagugacuuuugagcucaugcaguucuauuuauuuuucucucugaaaguaagaaacuuucuuuaaaggauuucugccauuuggacaaugugcuauguccccauugguguuaaucaguuggugggauauagaaaagcaaaguggccaggcucagccuuuucucucgaucuuuuuuuuuuuuuuuuuccuuucuuaagaaagggucuugcucuuuugcccaggcugcagugcagugguacaaucagagaucacugcagccuccaacuccuaggcucaagcgauccuccagccucugccugccaaguaucugggacuacaagcaugcacuccugugcuugguuaauuuugacuauuuuuuuguagagauggggcuugcuugcuuuuuucuccagucuggucuugaacuccuggcuucaagcaguccucucaccucauucucucaaagcacugggaugacaagcucuuucuuuauaccaguccucaacuugcacucuuuccugcauacagcuuguuucucuaauguggcuguucucauguuuacuuaauggcccagccaucuccuccuccuccuccuccuccuccuccugcuuucuauucuccuuccucaucauuguccucuucugcgaguucagaaaauuggguuacaauaccuacaacgugcagugaggacacucuuuuaucauaaccccaguaggcuuauggugcuuguaucugauuuuucauagucuuucgcuuguuaauuuacugcacauauguuccuuucucuugugcauuacugauguguuuaagaaucuugaauaucuauauggugcuuagagauuucacagcaguugauugaaugcuguuaccucagcauccucugugaaacuggguaugacuacacccauuuugcugaugaggaaacugaggcauaagaggauccgauaaauuacccagagucacacagcucacaagcaagugcaggcuuccagccaagguuugcuggcucaugcguuucaugccuucucuaugguaccauacaggcacuuugucucccaguggaauauaaguucuuugaggccaaggacugugucuuauucuguguugcaucccuuuggcuucagccucauugucuugaguuuauuaagcauuuggaacauuucagcugaaugagugaaugagugaaugagugaagccaucagucaaaucagaacacugcucacacaugcaucccaaguccagcugucgaacgucuggaacugagcaguauggagccuguuaagaccagugaugcuguggccugaauaacaacaggauaggaacauucccuucuucucauaaaucuuguaaauuugcauuguuugugccgaacagggcccguguguucugauagcaaacauggagaggcccaaaaggcugaucugggaccauguccccauugaacacugcucugugcugagucugcagaauauuuaaauaagggguuaauuuauaaagugagcuacgggaaaguuuccaggauugucgugcgugugucucauaaaucggcacaaauugaaucuagguuucuagguuucugugccccucagcuccuaaguaaaccaaaauuuauugagagguguauagguugccauccaaagaaacauaguaagugagaaaaguguauccucaggaggucuguaaacaaggucugaaggcuggcagaaaggaccagggucugcaauguagaauccccauugccgaugaucagaaaguacagcguaguuuguugcagaugaagacaggguuccaggaauucuugaucuuucuugaacauuccacugacuucuuaacagaauaaagauuuuguauauugcagagauaauuuauagauacagguacaaaggggauacagacaaagagaaaggcuaacuucaggauguugcguaugucaaaucauuacauuaguuuacccagaaccaaaaaaauuaugcaauauauaaauaugaagcuuuaguuuuucaugauuguucguaaugacauuauuaugauaaugacuguuuguaauaaucaugcguaccaccuuagucugagcaaucauauuagcaguucguaauuauugaagggcugucaggaaccagacacugugcugaguguucuacaaacuguauuuccagucuucuuuuuuguucaauuuccacucaaauuuuuaaagggguuuggagggcguuagugugcccauuuuacagagguggaggaggaagcuccaaaaaugaagcccaaggaucuuaagguaauauaugggcuugaauccaguguaucuugcuccgacagccuugcuuuugucauuauccaacauuagcugucuuuauuauaguggccuucuuaccaccuagaaaacaagugccagcauucuaguaaaauuuauucaccuuccgagauuauuuacuauuuuagucuguagcuuuuaucccuuuaacuacaccauucaaagcguugugcaaaauauucuaguaguaaauagaggcuuuaaauccacacguugauaauggucaaauccucuuaaaggggccagcaacaaaaaugacuuuaaaggggaaauauuccuucaauguuacaagcgcccaugagcauguuaguagagcaguuguguguugaagaaagagaagguggagugauacugaauaccccguaaaaucacacaaucagcacuuaagaauguucacacaguuguucacacacauauugauaucagaccuuauagcaguccuauuggcuagaucaguuauuaugaauguguuuuauagaguaggaaacagagaugcgacgugacuugccuaagaacacacagcaguucugaaacucacccugugcuaaucugaccucgugaagaaauugagcaaacuaggcuccagggagaaacgaaaacaauaacaacaaaaaauguauugccaaaaaauugcuagcagacaucuagaaaaaugucuucaacuucuuuugguaggaaaagaggaaaaauucaaaucugaauucaacauauuuauuuuuuuguuucugacuuuuuacguaaacagagcucugaguuguauccucagauauauuugagacuaacaacaaggaaauauaaaauuauguuacuaccuaagcugccacuucuucaaagccucguuauucuuguucccuucaauguauuucaacuccaaaauacauagugacaugaaaauuguguauucacauuguucuauugauuucguugagaaagugaccuuguaugcacacaugagaauuuagagaucuauauauaccgccuggccucuucuuuguaaggguauaacagcagugguuaacaugcauuuuuuuuuuuuaacaguuagauuuacucuuccuuugcacagacuaauagcacacugagguaggauccagggacggcuccuuggcaaguuguacugcuguggccuagggagggacaacuggcagggccacacaaggagguaaaaccuuaugcuccauuugcaaagccaguggccccagcagagauaggaggcccucucugugauuucggcagugguuucccugggauugaggucuccugaaacuuauucccgcaaggacauacuacuguggacccaccugaaggguggcauccacucuucuaguaggaucucacauugguauuuucagacacuucugccccuugccauguuuaguaagucaucuauguuguuugggaggaaagagaaugagcauuccucaguuccugcacugcaccaggccuugccaauacaguaccucauuuaauucuugcuaccauccuugagguggcuggcauuaggccauuugcgggguguagaaaaugacaugcagaaauacuguagcagcucacuuaauaucaggcagaugguaaguggcagagaugaggcuggaccccaggauuucugaccuaauuucugaucucuuuaauuauucuauacaccaaaagccccugugguuuggauuccuaaucacgggacugagaugaaacagaaucucuuagcauagggggccaagcaguagaugggcuuuugcgaagaaguuuuuucuuuuuucagagucagagguuggcagcaaaauaugagagauggaaggucaagugcagcagaagagagaaacagggagaguggagguuguucucuagaacauagaagccgcuucuucaucccacacaauggaaaccagagcccagauuauauuaacaagaaguuccagaauugcagauggcccuuugcugcuuagggaggggggagaagaagaaggagaaaaagaagaaaaagaaaaagagcagguggaaacuuaaaaaaauguuuagcugcauguagauggcuuuuauuauaacugcuaggcugaaccagaagacuugagcuauguaaaaaugucacuugcucuuaucacgguucauagagauuaccuuucaacgcgaguuucauuuucauuucuuccaacacuuagagaagugaacgaggcagugacuccuuuauucccuaacccucacccagcaacuugcuuuuuccucuguguuuugugucauucugugugauauugcaucaaggcaauucacggcagugguugaaccaaaagcaauuuaagucaaaaauggacaaauauggaugucacuuauaaggcuuguucaaaggccuuugacaucacucaaagccugaacacuucucaggagugggauacuuuuuuuuauuauuauuuuuuauuuucuagcagugcaagauugaagauuuaauacagaccucuuaggcgucugcgugguucuuaccuagaaacuguuuauuggugaaccaaauauuuuguaucuuauaccaagaaagaggggcugacaaagauugagugauuagaaauccaagugaauuucuauuuauuauuuugacuugguaauuuguaauaacaauagccaccaucuaucuauacuuccuagauuugggcaugguguuaggagucuuauauuuauuauuuuacuuaauuuucauagucauccuguguagaaauaucaauaaauauaaagguaaguauuauuguccccauuuuacagaugagaaaauggagucccagggaccuaccugcucaagggcacagaaagcuugaaugaguaaauuuacuuuguguuguuccaaagguuucuccaaaggucuuugcaccucccaaggcuauucucauuuugagaaagacuggcacaguuagaggccaggaacccaucuuggcugugugccuucugcuuugucucugggguuguggggaaggcugguagcuugagagccuccuccuucaacucugucaggcugcaugcacauuggaagguagcuuuucagguuguggugggugguggugaagcagagggaugcaaagcaggguacguggagggcugugccuuggucauucccaggaagcaaagcgagcgucaaaaaaagacaggguaguugggccauggcguugcagagugacagugaaccaggaaccagaagagcugacuucagaggaggcuuuaggcgcuccugcauguugauucuuagagaacuaaagacacaguugcaucuuaaaauguugagacuuacacguauacacaauaagaauauuuucuuuggcugcaaauguacuauaaaagagugaaaaagccaaucccaaaagauuacauugguaggauuccauuuacauaauguucuugaaauuagaaaauuauaaaaauagaaaacagauggcugggcacgguggcucacuccuguaaucccagcacuuugggaggccaaggcagaugggucaccugagguccggaguuccagaccagccugaccaauauagugaaaccccaucucuacuaaaaauacaaaaaguuagccgggcgugguagcacacaccuguaaucccagcaacucgggaggcugagacaggagaauugcuugaacccgggagucagagguugcagugagcccagaucgugccccuguacuccagccugggcaacagagugguacuccaucucaaaagagaagaaaagagaagaaaaggaaagacaacagauaagugauugccagggacuggagaggaguggggggugagugggaaccagaguggauuuaaaacagcaacuggaggauccugguauagauggaaauguucugcaucuugacugucucaaugucaauuuccugguugugaaaucguacuagaguuuugugagauaucaccuaugggggaaacuggaucaagggugcaugagauugcuguauuauuucuugacugcaugugaaucuacacuuaucucaaaaauaaaaacuuucauuaaaaucaaauaacugcuuaauauuuugggggaaaaauucaacaaguaaauucaaaucacccacgagcccaccacccagagagagucaccugcucuauuuugauauauuuucucuuccucccuuccagucucucucuucuguuccuagauauaaaauggagagguuuuaaaauguaauuacaucuaacuauccccuggcuugguaauauccaaccuuuucauguccucagagagguccaaaggcuuugcugaaacuuguugguuuggcauugauuuugacaaaagacagcaacaagauccccuuucuaggaacccauguggauuacuauggauucagaauggaugcauuuuauguacagggcugugacuuuuucuuuccccuuccucaugcuaauagguguuaauacuuugcaauaaauauuacuuaugucuaugaaaugaacugcaucccagccugucagcacauauuuauuuucucauuuuaguuucuccagguucucacuguuauggaggguggggaggggguagaauaagguuaggcuggagggcauaucugauuuggaaaauacaucccuggugauguuccuaccaagucacaggcuugguuggugaugcuaaauugggacugaggaauggguuaggagaaggcuugaagaacccaccuccuaaaaccgucucaucaucgucuagagauauuucuccaagugcuuuuguuuccagugaccucccaaccccaggaacuagcgaagccuucaggcagguaagcgcacaaauccugcauuuucuaguuaaccauauauuauuagcuagugacuugagcaaguugcuucauuuuccugauccuccauucccuuuucugagccacaguuucuucgucuuugaguagaguuaacaaauuacuggguguuugaaagaucaaaugaguuagcacaugagaacaugcuuugcacaaacaaaguuguaugcaaaauaaguuaucauuauggcaugggagaaacuguuuguggacauugccucccaguugacccucaguguguacuuguggaauaauuuuuuaauauaaaauaauuaccaucacuaauccuaacugugcacauucuugacucugugacacugagcaaaauccugaaccucucugugccuugauuucuuucacgucuuguucuaguuuugaagagcgauucuugugugaauucagggagaggaggcaugaggcaugguaaggccacuguacgucugugguugacaaauucaguaggcccacagucaaugcaaaaguccucuugccucugcagcacaguuacaaugaagaggagcgauggcauggcaugaucccacuacuuagggaggcuaauuauguagugucuacagagccagugguuuauuuugcauuguuuaugucagcauuaagcaguauuguuacacaguuuguaagucuuaaaacucaguaucuacucuaguaguugcuccaaaugugauguccucauaaaucaccgagggaucuuguuaaauuuggauucugauucaguaggucuagguggggcccgagcuucuuuguuuccuuuucuuauuuaauuuuuguggguaccuaguagguguguauguacauauauauguauauauauaugugguuuuuucaaaaaaauugugggcacuuaguagguauauauauuuguggucuguguuucuuauaaauugguaaucccccaggggaugccugccuuguugguccagguaacacacuuggaguagcaaacaucuagacguaguucucaauaguaggacuauugccaguggagggggcauuuuggaaauuuggaaaggcauuuugguggccuuuggcacuuagcaggugggguccacggguccauccugugaugccauaggcaguccaauauaacaaagaacugcccucgucccgguaacauacaccugugcccccagacauucauuucgguaaaaaacuuguuuccauugaucugaccccagaauucccugugcuuauacagauacacaacgugcacugggucuuccagaaaugcaggggccuucuaaaucaagggaagauugugugguguuuuguuccagucuuuuaccaaggucucaauaccaucuugaaacaucaugcagcacugcucauaauauuugagucaccauaaugugaucugucuacauauguagcuguuuguauucauggugauuaaauaguugggugcuagacaugcccuuagcgagcagcucaugagagcagauuuugccuguuucuuccaaaaucuggauucagugacaucguguugguagcuugaaacugaccguggugagaauauuuacaccauggaaaguggcaaaugcuacuaauaaggaugauuguuuuaguuuucauuuuguaauuuucagaguugguuuaccaauaugaugucuguauuaaaauauauguaaugcugcuuucaaaauguuaaguauuaugagaauacauuaacaaaacucuggcgaauuuuuugucuuauguuucuugaauccaaaccuauaaguaggugcaaacauuagacgauuucauuuugggcuucugauacacuccuguccgagaaguuaccuuugaaaauguguacuauuuuauugucaauuauguuuucuuuaaaaaaaauuuaugacauauuacuuuugcuaauuauguguguggguagauuauguuauucaugaauuuuauuucaggaccuugguaagggguuauacaauauuucuuuugaaacgagggucucgauuauugggcuugaguauccugaucuaauuaaugcacuggacagagcuggcagacgugugggacacccagcuauucucuggaagggaagggggauauaagagacacacuauaaaggugaaugguaauuggcaucuccccuucaaggggaccaggaggaucugagcugacugggugccuuuguggaaguguguuuugaacugagauuagagagaucagcaauguaucucuuaaaguaauccaggaggaguucauuuucaaccgauucagcaguggaacacuugaagaggaggaagucaaaauucaaaauggguugggugcaguggcucucuccuguaaucucagcccuuuuagaagcugaggcaggaggauugcuugaggccaagaauuugagaccagucugggcaacauaggcagaccccaucucuaaaaaaaaaaaaaaaaaaaauuaaauuagcugggcuugguggugcacaccuguaggcugagcugcucgggaggccaagaugggagaauugcuugaggcuggauguguguggcuauggugagcuaggaucacgcuacuuuacuucaaccugggugaaaaagugacacccuguuucgaaaaagaaaacaaaaaguuggaaaugagugggaaaggaucuaagaugauuggaaacaguguacauagaauacaagaggaguugggcaugcuggcucaugccuguaaucccagcacuuugggaggucaaggcggauggauugcuggagcucaggaguuugagaacauccagggaaacauagugugaccccauuucuacaagaaguaaaaaaaaucaacucacaccuguagccgcagcuacucaggaggcugaggcaguagauucauuugagcccaggaggcggagguugcagucaaccaagaucacgccacugcacaccagccgggggugacagagugagacccuaucucaaauaaaaauaaaaauagaauacaaggggggauaaagauagacuuaaaauacgcucucuagaaaaaagaaagaaauauggaaagaaaucuaauuuagaaaaaugcacgcacccacaggcacgcuucacaggacuggcagguggagaggauguuuguuaacagggcuggcuauuuuacuuuaagugcugcaaacauugcacuaauguuugggucuuugcuuuuggcaaucacuucucuuguuaauuuuuuuuuggcaccauagaaauguuuccauaaauagugcauucaauggaguguguuacuuuauuacugucagccacuguccuaggagaggaaaauucaauaaacacaaaagcaaagauuagaacguugaaagcuuccaauuccagauccuucaugagcuuguaccucuaaagaaugcgauuuuucuauuucuccaccugcaaaauucuuacuuuuugggcugguaaagccaccuaggucagugccauguccaacccaaucuggaaaacgauuauuguggugccuguuuuguugacuuaacaaagccaaucgcccauuccuaugcugcuaagaugcgaaugcccagcucaggggaugagauuacugucagcuuugccuaagcuuugggcauuagcacccuccauaugcaacaaacccacaaaugacauguuuugacucuuugacacagaaugguuggaaaucacuuccuuggccagagcagggguccgguguaaaggaggaaauaaaaauaaaaaagcauaaaugaaugaggaagugagcaaaucacacucaucgaggagcaaaauaauucauucccucuccguggcucagcauggaugcaaauaauguaucauuaaguaaguccacaaaacaaagacagccagcauaacuguugcaucaaauauuuagccagagccaaaagcaauuuauuauguuuuuuaaaauaaguuugauuuacuaaccuucagcacaaucccuauuuuuagagguuggcucauauuuuuaauuuguuuucucugaagcgcugcauccuugguagcguuucagcuguccacucgguuccuaauggcagagcaacaccgaaaagcguaauuacauuuccuaauuauguguaauuaggcaaaacccagaugauguauucaacaugcucugagaauagccagggguuaaagacugcuggaauuugguaacauuuuuauaaauaagcuggugcguuauuuaacguggaggucuaaggugacgcugggugccuuguagaccgauacugugguugaaaucuaucguauuuguuuauuuagccaaguaaaacuguaagugauuccccaccuccauaccuuccccucuuuuggaaaccagaguuuaguugugcuauucuuagcccaagagaggcccucuaaacccagaaccauaaaguucugcuuacugacagccuaagugauauuuauuuuuucaaagcuuaauccuuuugaaacauggagaaauaaauacauccucuuaucuaccauaugccugggaugggaaauaaauucuuauuuuccugccgugugguaccaguggguuacgaugaauaauuugggcagucucacugaagauaauagggaagccuucucuauuaccagugauaauuaugaaucucauaauggaaaacaucccgagcccgaacaucaaucagggaagauaaacaaugggaaaugauagguguacaaaagggaaaauggcaacagcacauguggagggaaagaccgcagaauucuggcaggguuauaaaucauacagucaaauaauuuccgugcaauuaauauccucaaauuaaaacauaccuuuuuaaagaaagauuuugcagacuuuuaagcugggcaacugucugccuuacaagaugcgucuggaaaccccagugccauccuccuuuuuuagucuuguauauuuauguauccccggccagaguuggcuggggcacagucuaacagugucaccguguaagcugacccagugaccuugcucuagcucaccagggacugagcauacaccaaaguggccagagcuagugguugcugacucucaggaucuuuggcccugagagaacaacaaagacuggccuauugaggcaggaagucuuaacuuccuuggccagccugaaaggcugucuccaaccaugcggacacagcgcagugaagcgguuggaaaagcuacagacaaauggaaaaccuucauuccaaagggucguugucuccuccuauuuaauagcccugcauucaugcacuuuuuuuaucuugcugucuuuuuuuuuuuuuuuaaucaaauaccaaaguacuucuauggacuggucuuaaaaaaaaaaaagaauccauucauaacugugaaaaaauacugccuauuagucugcuauuguggcucaaaaugaaacuuaagacuacauggcuaauuuauuuacugcaucaugggugaagaccaacaagguuuccagccuuuccuccuaucugucugcauguagaaauucacagaccacggccauucugacaugaauaucaaaugagaaguuuuccauuccaaacccuuuuuaggagcggccuggaaacuggagucaacugucaaauauguccuuauggccacaaaguaugcucauggauucucuuuuacaggcuuagcauaauauuuuauaaaacauauuuuuaaagaaaguguaauuuucccccaaaagcaaggguuuuccaaugccauauaauuuacuaaguguggcuuugcugcguaauaguccauaauuuauagucagccuccacaaggcaaaaaauaacuccaagcuaugauuaaguaaguaauggacaagguaacuaauauuuccggaagaauggccuuccagacacucauuuuaagugacaaaaugguugaagguugagauauguacuaauccuguacuaauuuaauggaaucaagaaaugacauuauaagcuggcuuaugugggcacuuaagacauggagcugagagugaauaugagagugaauauucugcacguccauuuuaaugaccuugugccucauuuuccccauuuaagguagauggguuuaugccuaauugugccaccaguuuuucccauaaaauaauucauuuggaagggguggccuaauccagucugaaccaauucuaagaugguagcguggaugcgggaggcacugcacaggauggaaagcauggaguuuggaaucuggcacaaguggauuugaauucagacuuagucaucaggagcugugggaccuugggaaagguugguugguugguuuguuccaguuuuuaaauuuugaaauaaauguuggcuuacagaaaagccauaaaaaauacugcaaagauuucccauguacucuucacucagcuuccccuaauacuaacaugauacauuuuucagcacugagaaguuaaccuuguuaugaugcuauuaacuacacucagacuauaacugaccaacagacuuuauuuggauuugacgguguguccucuuccuucuuuuacaaccagauaccaccuggcauuuauuaucauaucucuccaguccccucuggucugggacaguuucucaugcauuauuuuuuuuaauggccuugaaauuuuugaagaguuccggucaguuauuuuguagaaugcccguaauuuggguuugucugauguguucucuugauuagaaugacguggugcauuuuugggaggaauauacauaagugaugugccauucuucggccaucaagucagaggauguguaaugugaaaauaucuuauuacuagugauguuagccuugaccucucgguuaacgugguaucugccagauuucuccacuguaaaggaucauuuuuuuccuuuguaauuaauaaauauauugggggagguacuuugggacuacuucucaaauuuucauccauuaauuuuagcaucccucuggggaucuugccugcaaugauuaauacugugguauucucaugacugauauugucuuucugucaugccuucuauuuuuuggugggaauucuucuacauggaaggcuguuucuucuucuccauuuauauugguauggauacgugaauauuuaguuuauucuguaggucauaauacgacaguauugugauauauuuuggugcucaaauuguuccggcuuuggcccauaggaggucuuucgggcagguuccugcacccuuuugacaugccccguucuuuuuugagcacuuucuuauuuuuuggcacuguaagaggcuuuacacugucaucuuggacuucccugccucagucuuggaauuaacucauucuccauggaggcuugguucguuuuauuauagaaucauauuuagaacuaagaucuaggugcuaguugcgcucauuacugcuggagugucauugcuucuagaacuucucaacagaguuuagaaauauguguauuauacaaacccaugcacauacaccuaucuccauuuauuccuguaucucuguguauauuauaauuuuaguauauuuauauuucuuucuggacacauuccauuauuuguucauauauuuauaacauaucaguaucuauuauaaauuauauauauguacacuuuaauguguguuuguaccuaauuccaauccaacacaacaacuggguuuuuucaaacuuguuucuuuguuuuuuucuuuuuguggagagcagggucuugcuauguugcccagcucagucucaaaguccugggcucaagcgauucucccgccucagcuucccuaaguguugggauuacagacuugagccacugcaucuagccacaacugaguucauuauucugagcuuucuuugggauguuauuuaacucucaguuucuucuucuauaagauggaaauaauaacaacuaaaggcuaggauuuggggaagguaugguaaauuguaaaaaugguagcuuguuuaaaaaaaaaaagaagaagaaaaaggaaaacaguauuucccucaccgcaucaacaccuguccuguaugacuggcauugcccaguggaaucuuagcagcagaggcaugacaagcggucagauacugggacuuucuguuucguugcuuacaacccugugaccacugcacgaacaacccugagcugaccugcuggagcaugguggccacauaaagggagagugguugccccagcugauagccugucggugccuggcauaugagugaggucccucuagagucaucuagcuacuagccaagcuaccaccugaccccagacacaccagagaaagagcacagcccauucgcggacucagaaacuaaauauaagaaaaauggucacuguuguuacucacuggguuuugcagggguuuaauauccagcaaaugccaaugaauuagaguugacauacggaaaacaaguaagaguaacuuuguacaccgugggcucccaaucagugcugcuuuucguuguugauguuguuguuaauguugaaaaaaucuucaagucauauuugcccccacagaccuucccagacagucuaacuaaaugcacuguauuugcuaacuguuggaacuuggcuuuuggacuagaccagcaccucgagaaagaaccacuguuaaaauguaaggcucugaguguuuaucagcucacaccaaggaagagagagcucaggagcgacugggcaugagguggagugagcacugugaaugcuggggaauggaaaguccuuuaugugguguugccuaaggguacggggaaccuggccugguguugggaggaaacagggugcagagugggaagggcaggaguaucuaaguggccaaauuuagccuaauuaacagauuugccuagggcugacccugaagcagaaagcaaagccuagaucagucugcucuccuccuaccaacaggguaaugaugagguugaaccaccaguucucaaugccauacaugagauucccaaaauagacgggaguuacacagagaccuuuuuuuuuuuuaaccuccucugagauuuuuuuuaaccuccucugagauucuguauuuccuuaaugacccgaaaaaucuauuuagcccaguuuuuauccuugcagauaaguuaguacgcuucuuuuucugcugguugugaucauauuucuauuuagggguaaaggugcugaaaaucauuugcugcgaugacucgcaaagacauaguuaccaugagcagcaguaggauggguggccaccagacugccaugggcaugaucacuguugacaaucuugccacagcuccccagggucuacuuggugucccacggaggacagucuauacaguaacucaacauuaacuguguaccccuccuaguuuggccacuguucugcccaaacauacaagagucaauguaagucucugggagcacucaccuuugggcauguugcuacagagucacucauuccuagaaauugcgaagucacgaaguugucaaaaaacacaacgacaggccgggcgcgguggcucaugccuguaaucccagcacuuugggaggccgaggcgggggggaucacgaggucgggagaucgagacuauccuggcuaacacggugaaaccccaucucuauuaaaaauacaaaaaaaaauuagccaggccugguggcgggcgccuguagucccagcuacuggggaggcugaggcaggagaauggcgugaacccgggaggcggagcuugcagugagcggagaucgugacacugcacuccggccugggugacagagccugaaucccucucaaaaaaaaaaaaaaaaaaagaaaacaacuacaaccacauuuugagauaggccuuccuuggcaaacuuugauuucguuucuguauuugaggacaaaacacaguaugguuguuucccucccuagacuagauuucuaaucuugaugcagugagcaaagggcgagguuuauauuguucuuaccugagccaaaggacccauaaaaaauagagugauaggcugggcugggcgugguggcucaugccuguaaucccagcacuuugggaggccgagguggucagaucaccuaagguugggaguucgcgaccagccugaccaacaugcagaaacccugucucuacuuaaaauacaaaauuagccgggugugauggcacaggccuguaaucccagcuacuugggaggcugaggcaggagaauagcuugaaccugggagauggagguuguggugagccgagacaaugccauugcacuccagccugggcaacaagagcgaaauuccuucuuaaaaaaaaaaaauagagugauagagugagaauuuggcuuuuagucuacagaaguuuucacuaccaguuucugugugugugagugugugugaguguguguguguaaaauaccaaagagaaaacaauaaaaaaauagagaaaauaauaauaacuagccaaugugucaucacuccagacaacagccauggucaguauuugguuaacccauucagauuuuccccuaugaaugaguuuuuucgccuccauaauauuaguuauaauacauugauacuacaucccgaguguuucacuuaacauuauagcacaagugucuuccccuguuguaacauagugauuauuaaugucaaauaucagcuagauaaaagcugucaagugauagaaaguccuuauagcucaugaacucuucaauaacugggaauuuauaccguuuauaguuuuuuuacugcuaagaauaauguugcaaugaaacguuuguauauaaugcuguuuaguccccucucccccauuguuuacgauuccuuggaguuccacugcuacuucauauuuaccaucaccauccuuguucaccauuguugaagcuuuauguaaugacgagccucauccaggaccuacuugugucucugugccagucacugccugugaaccagggguguguggacucagggcucaauucaaaaaagaacccaaucuuauugggacaaacagauauugauaccccuggucuuugagccccacugucuuuucacacuaaugaguucuuagugucuauuuuuggugauugaguagaacuuggugccauauuggcucaacauggaagauuucugugaucacuuauugaucagucaugaauaaggaaucgggauggcagucgggagugugccaacaccucucucaguauucugggucucucugcauguaguguuucuuuugcagcuccuagagauaaauuuuuuaauguauuacaugugaguuauuugaaagaggguagguguggacagugaggccaggugacuuaauuuccagaagcuugccugugguauuuaccuugaugaguucauuaacaauauggcuuucacccucaaacuugcucauucagaaauuagacuuugugagcccacuaagaguaggucuuucuguuagguacagacucuacaauaaccaaauucacagaaacugauguguaaacccagggucauaaacaauaauuuucaacaggagcuauaauuaucacauaguuugaaaugcucuuguuaaucugaguaggaagagaggaugagaauuuucuuauagguggaacuacagaaaaagaguuuacuuauaggcagaaguacggguacugagccaagugacauuguaaguuauuuaauuggcaaaugauuaaagcaaaggucauugccuauaugacucaaaugcuugguugccucagaagauaaugagccugauacuuucacagugaagcuguauugcacguuuguguuuguuuauuuuccaucuuucccacuagacggugagggacuuuaucugucucauucaccacuuuguccaaccuaggacagugucagacacauagagaugcucaauaaaucuuggcugaggcaauacguuucaaaauacaaggugacuccaaauauaaaacaauuuuuuauuuucaaaugaaguggaccuccccuaaauuuugugcccaguuuauaaacuuuaggggcuguagaugaacuguucaaaaguuuuauuguaggauuucacuugcuaaugcauuuucacaaguaauguauuuauuuuaaaagacuggaguuuuuauauauccuuacauuuaugaaauaauuucauuuaaacccuucaugcccaucuucagcaucauugcuaaagccucuugguuucuguaccuguaaucuucauucauuccucagcuguuugaaacacagcacuuuugggauccuuguauaauacuggccccacaaucaagagugacuugaacugggacauguuuguauuucuucaagaugacuuuucauucucucaucucauucauuuugaggucauuuuguuguugaaauguuagaguucaaccuuaaauacuuaagagcauggcacugucuagagaaagggagaugagcuucugugguagccagaggucaagauggccucuagugacccucacuuccuggguuuuacauugcaguauauuucucuucuacucugaacaggauuguccuguguaaccuacagggggaagugauagcgcaugaccucugaagcuaggugacaaaauacauuuggacuucugcuuugcuucucuuggaucacuccuuguggcagaagcuagacaccauguugcgaggauacucaaacagcaccauggggagauccgcauagcaaggaaucaggcuuccaacagucagaccagauugccagccaacaugagcgagccuuguuggaagcaguuccuccaacccccuuuaaacuuuuggaugaccacagaugaaaugaccaucuugacuuaggagacacccaagucaaaucagcuagcuaagcugcuccugaauucuugacccagaaaaucuaugugagggaguaaauauuuauuaauuuuuaagaugcuucauuuuggaguaauuugcuacacaccaauauuaauacagagcccauaugcgcugccuacaggauaaauaauguaauagcuuaauaacaauuaaaauggaagaaaauguaggaguuccucaaugguuccaccuguuucuugagguuaaaaauguacacauuugugggcagaaacuuuuauacaguaauaaauucuuuguucccucugcauauagcacuuucucaaaaaguaguuuggugacaggcuucuuucuucucaucauuaaaugacauacuggagaucagucagaugaacugcaauuuauaucuugcccccacccaguguugauuugcccggggucauacagauaauuaguaaugucuuaucucaguuuucuuaucugcaaaaugagaauaccugaugggguuagugugggaguuuaaugucuguaagguguuuaauuuguugcauaacaauauguuguacuauacguuauaacaauauguuaauauguugccauguauagccauggcaaaugcauaguaaauagcagguauaauuauuauuauuuuuuucuuuuuuguuuuuucugagacagucuugaucugucauccaggcuggagugcaguggcgugaucucggcucacugcaaccucugucuccuggguucaagcaauucuucugccucagccugcugggauuacaggcgcaugccacgaagcccgacugauuuuuguauuuuuaguagagacaggguuuugccacguuaaccaggcugguauuguuuucauuauugugguuaucauuauuuauuuaguuauugaucaucaaaauccagaaauccaguuucagcaaacauuccauaacccggugugcuaaaacccccucacugcucuccauuacucaugaaucuucuugaccaugaggcagaaucuuuguauuuucuucucaucaaggauuuuaucugaaaaaccuguaguacuucgccuuucccuggguggagaagaggggcggauaaauacuucuaaaguaauguaguaugcacucuccugcgugguggggguguagugggcuuccuguuaugaaacccagcuuguaagcauguaucuacaucccagggagguuuucacugaaccaagagaugccauaagcaguccuuguuguaauaauuuaauagcgaagcccucagcaauagaucuucagguaaaauggaugcugacugucugucugucauaugaagauucagacauugauguaauuuaaaauacuuguaguaucauggauacaaacauaugccuuuuuauuucugaaggaauuuccagaauguucgauuaaaaaaugaacagaggaaaugaaaaauaaaauugucuguuguaccaccaccugaagauaaccacuacuaucauuuugcuauauuucuuucuauauuuuucucagcauuuacacgauuguuuuuacauaguagugacuuugccgaacaguuauuucauuucgcaucuugauauuuuuucucaauuaaaauaauaauugugaacauuguucuuucuacucuaacuacucagguugcuuauaaugagcuuguauuauaauaaaacuucauuuuauuuuagauaaaaugaaaagauguuacuaugcagguaacuuuauuuauuauuugcaugcaguuuaucaaauagaauuccuugguucagcaaaaugaaaccuuuaagucuuuuagcaccaaauguuugaaauuaucaugaaacacauucuaauuuggcagugaguucaggagaugaagacuguccuuuaguuaacaucaauagcuuucuaaaauauguagccaguuaauauuuuacuucugccuaugcaucccucaaauuguaacaccccuggaacauaaaaauuccucuauugagauuaacaccuaacgauaccuguauuugcuaauuuguuucuuuuuuuucuuugaagcagcauguugcuuugucacccagacuggagugcaguggcgcgaucucagcugacugcaaccuccgccucccggguucaagugauucuccugccucagccucccaaguaguugggauuacaggcacaugccaccacucccagcuacuuuuuguauuuuuaguaaagaugggguuucaccacuuuuggccaggcugguguugaacccccgaccucaggugaucugcccuccucggccucccaaagugcugggauuagaggccugagccaccgcgccagcucuauuugcugauuuuugaacagcagcuuuuuuuuuuuuuuuuuaacaaaacuuuaaaauggguuauguguuuuauuuucuuagugaaguaauggcuucucaaauuuacacuccauuauuuuauuuaaaaaaaucaguaugauucaucauaaauaagucaggacuaugauugacagucuaccuagaaagauuaggaaaguggggaccaccccccaauuauuaccuuuguuuuuacaaguguguuuaaaucucuuucuguuaauuuacaauuugaaaggugggugaggagaagaguuugaaaaauagauuacugucuucauuaauacagguuugaccuacaaagucuucacguacuuaaugauuaaaaaccaaaguacuaaauaauaaauuauaagaauuuauaggagucaucuucuugaaauuagcuuacugaauguucuuaucauaauaaaucugagugggugucuaauuuaguguuagcugacuaaaauuguauguugcggggaggaaaaaaaaacacuuuuguuugaagacaaaugcagugaguuuaaucacaggugaucugaaaggcaccaccuaucuuuugcuauguucacuuugcagaaacuuuggcgaaacuggcugaaugaagaucgauuccaauuuguaaauguggcagacaauaaaauuuccccaagcacuuugaugauguuuguguuaauacuuccugcucagagcuguagcccaucagauucuagagcuaaccgaagagggaagacaaccugucuucucccaguuuccagccuguauagacuuaaucauuuucaagguuuaagguuguuuuuguuuauugguugggguggagagagacgcaccaccucuccuaacuucuguguuugcuucccucaugcuguguggaucagaaaagauagccuguucauucaucacuuauuuccugacuuccaccuugggucugucagauucugugugaagcccaggggauccagggaaaauugaggcccaguccuuacucucauguaacucgaagucuuuuacagaagacagacuugggaacaaaucaaucaaaaugaguuuuguacggaaaaagucggugcacgcacaagguacccaagaaggaggugacuaacuuuaucuaacuuuacuugcagggcaaggcaaauaauuagggaaaguuuccuucagacaggggaagacaaauaugaguauccagggaggauguuucuggcagagggaucagcauaggaaaggaguucaggguugaaaagagucagucuggucccuagaaauaauuuuuuuggugcauaaagggccagaacagaaugacagaggaaaaugauaaggauuuaggcagggacugcguuggaaagggccuugcaacaggccuggacguuguuuguaggcaaguaggggcaccgaaagcuuuaaagcagggaguaacaggcuuguagugacuuuuaucgaaguagaaguugaauagaucuagccuggcacaguggcucacgccuguaaucgcagcacuuugguuggcugaggcggguggauagcuugaggucaagaguucgagaccagccuggccaacaucacaaaaccucauuucugcuaaaaauacaaaaaucagcugguuguggugguacaccccuguaauagcagcuacucaggagucugaggcaggagaaucccuugaacccaggaggcagagauugcagugagcccagaucaugccacugcacuccagcgugggugacagagcaagacucugucucagaaagaggaaagaaauggaauagaucucuuucaguacaaugggaaggggcauauaauucaguacuuuaaaaaaauguacuaucuuaugaaauagaaauauacauguacauagauuuaacacacauauucacgaacauacacauuuacauauacagucaucauugcuuagagaggagguuguguucugagaaaugcuucguuaggccauuuugucauugugccaccaucauagaguauaccuauacaauccuagaugguauaaccugccauacuccuaggcuagguagagcauauugcucccuggcagcaaacauguacagcauguuucuguccugaauacuguaggcaauuuuaauacaaugcuaaguauuugcauauacaaacauagaaaagguacaguuaaaauaugguauuacaaucuucugggaucaccauugcauaugugguucauuguugaucaaaaugucauuaugcagugugugauagugcuuaaauaauuuaucucacauaugcaaagaguuuuggcuaagggaaaagaaaaaugugaaccuccuaauagaaaaaugggcaaagauaaugaacaagaaauucauugaaaagaauuggcaaacaugaaaaaauucucaacuuuauuuuuaaucauaaaaauggaaauugaacaaugagauacuguuuuucaccaugacauuggcaaaaguuaagaaggcagauaacuuccauguuggugagcauguaaguauaaaaagguauaaaaaagaagaguuguccugaaucuggucuggaauagaaccuuuuuuuccaugaugcaugauguaauucacagccucauuccugauaaauugcuuaagcaauuuucugauaaacuuuaaugcgauuaagacuuguucugagaaaucagucacccaucuacccaagcugacugucggucaagagucuagugaccuuaaaccaaauguuauuuuccuuuuguaucuagccuaacauugacuaucuugucauuucauuuuccuauaaaaugccuccaccaaggcugaaucuuugaauugaucacuagaggccuuuucccuaguaguaacauuauaauaaaacuuugacucaugcucauaacucgauuuuccaaaaaguuuuccuuuacaggagaaaagaacaucugcuguuuauaggagcauaaauuguuuuugguuauuuugaagaacaaguuggcauuuuugaccgaaauuaaacacaugccuuuugaucaagcaauuccauucuguaccagaaaauacagaaauauuugaaugaaugugccaggacacccaauuagaagaaugaaugcuuuuuuagcguuauuuugugugcauacauauuuauuuaguuauuugaccuauuacauucuaaauugauauuaauaaagagguauuugaguuacaguuuuuccaaaguuuuaaauacucuauagcaaaaaaaggaaaaaugaaagaaauuaaaaagauaccucuauauacauacauuguguguuuguguguguguguguguguguguguguauaaauuggcugugcaugauauaaguuuuuauuucaaucguuuuagggguaaagugguuuuugauuacauggagaaguucuuuaguggcgauuuaucagauuucaguguacccaucugagcagcauaugcuguacccaauauguagucauauauauauauguguguguguguguguauguauauauauguguguguauguauauauauguauguaucuguauauguauaauggcuguccaugauauaauuuugaguuggaaaaagcaaauugaagaauaauacauguauuaucaugucuuuaaaaaaaaacuauacacauagcugaauguuuuuguguguauuuucauaaaaugauuugggguugaggugauaaacaguaauuauaaauagugguagauaacuucuaucaccagcacggaguguggcuuaggagcugagaaggcuuugaggagggaauuuucuuucuuuuuucuuuaccugucauguuugaauuguguuccaucaacauguccuuuuuauuuuuuugagauagugucuuacuucaucacccauucuguagugcagggcacaaucacagcucacugcagccucaaacuucuaggcuuaagugauucucccaucucagccuccucaguugcugggaccacuggcaugugucaccacaucuggcuaauuuuuugaacuuuuuuguaguuggggucucaccauguugcccaggcuggucuugaacuccugggcucaaguuacccucccaccucagccucccaaagugcugggauuacaggugugagccaccacggcuggccaauaucuacuaguuuugaaauuuaaaaaaaaaaaaaaaaaaaaaaaaaaauauauauauauauauauauauguauauauauauauauauauauaugaaaaaaaggacaaacgauuucaguugcacaacuauaaucgaugaaguggcuccuugauguucucgggguaaucugagacacuggggagaacccuccaccuuugcagagaagcaggaugaaggggccuaaaaugaguucaacugauuucaacuuuguuucccagcauaaagcuugggcugagcugccugaaagggaaguggagaaggcaggaauggaauugauuuuuccccccugcugaauuccccuucucccuacucccuuccugcaauuucuaauaaauuagaagagcucugccuuccagaaaagagcagagguaccuugcaguacuuuugggaaucuuaccaggaagaacugggucuacuauugcaaaggaaaagcuuuuuuuacaguguuaaaaauuaauuaaaaauggaauguguuauagcucgauuuuuaucauuagcacccauuccagagggcauguugcuguuaguaaaacuucagauuuuuccugucauuauggauuugguuuuagggaaaauaccuucauguucagcauuuuaugugucagucccuaaaacucaugaucuucugugauucucuugguuuaagagcagggcgaguaauguacucaaaaauuucuccauagccuucuggguuagaggauauaacagcuggcaaacagaacacuaauagcuauugaugguuauuuucaaaggauggacaucgauaguuaaguuuuaaggaagaaaaugaagaggaaauuuaaugugauuuaacagugauuuuuuuuuuaaagacauuauuugcaucuccuauuuucacuuacuuauaaacaggugguuuccaaguagacauauuuuuugcuugcuugaaugagaaagcauaaugaacuuugugauuuggugacauauccagauagcuauagcaaauagcuauaaugccuuagauaaauagcauuuucacgaguaaacuuuuuaguucucaaaagaaaaauuguaacaauuuucuagccgcauauuagcauuaugcacaaacacauaaacuuuuggcuggaauuguggaauaugaaguagcucccauccuuauuccaucgcccauauccuaaaauguagauuguauuaguugagaaauuuuaccaaauauuuacuuauacugugcuauuauuuauacuauuugucaauuccacuauaguagaugcuuaauaaauauuugugaaucaguaaauggauggaugaaugaauaguggccuacuucugugaagguaauugaagaauucccacacuuggcccccuuuggauauaacgucuguucugagcaccucccauucacuaucuugaugccucacauaagaccuaguauauaguaggcagucaaugaagaucacaaugaauuggcuagacuuugauuuauucauuuaugcaaauugccugacauucaaagaaaaaagaaggaaaaaauggaccucuuaucaugugccagacauuguucuaagagggaaagauacugugaaaaagaaaagucccuauccugguggaucuuagauuaucguggagaagguaaggcaacaaacacaaaauaaauacuucauauaaguucagguaaugauaaugcgugaaaaagaaguguucuuccuguuagcagugccaacauccgcuuuagugcucugcugcacugcaaaauguguggauguucuugaguaugucugggaacuagcuaaaauuagggaguuaaaaugauccagcuuagcucaggcuauagggaggauuucucucccagguguuuguuuuguuuuguuuuugagauagggucucacucugucacccaggcuagagugcaguggccucaaccucccaggcccaggugauccucccacuucagcccccugaguagcugggacuacaggcgcaugccguaacucgcaacuaauuuuuuguauuuuuuuuuguagagaugggguuuugccauguuuccuaggcuugucucgaacuccugggcucaagcaaugugcuugccuuggccucccaaaguguugggauuauaggugugagccacugugcacagccucagagguccugucugccugccugccuuuccucccucucucucuuucuuccucucuuugcuucuuuccuuuuuuccuucucuguugaaggccugaauaaaauaaaagacugaguaagaaagaauugacucccucugccugacuucaagcugggacguaagucuucucccaguccaugcauccauccauccaccuauccaccuauuaacuuauucacacuggcuuuaaaauuauuuuuggcuccagcuuauuauuuuaaaauguaaaaugauuuacagaaguugacagagaguauaauuaaaucccaugagucuaccauccagauucaguaauuauuacauguggccauuguuguuuuaucucucuccacccacuucccccaugccugaaaauuuaccaaaguaaaugcaagacauuauauauuguuauucauagacauuuugaguaacuaaaaguaaggucucuuuaaaaaaugauaauuacaguaucaucaucacacccaaaaacaucacaaauuauuuaauaucaugaagugaaggcccauuuuuccaaucauucucuaaauauuauaaaugucaucuuucauuaguuuguuugaauuccagguaaaaaccuuuaacucauuuccuucuuuugauuuuucaaaaguugguugaauaguuucugucuuaaaaaguccagaaauuguugaaauagguaaagcacaaaagaaauuaaauacaccauguuuccaggccucuaauguuuucuauucaagguuguaauauccagugcaaggcuaaaauugcuuucuggugauaaacauuugagaaagauuugguuguuggugauacugaugguuguaguaggagucucuggagaaauugaacuaauacuauauguguguguguaucuauguauagauauagauacacacauguaucuauuauauauauagagagagauauaugcauaucuauacacaccuacgggugugucuguaucuauacacacaccuaugggugugucuaucuauaucuauacacaccuaugggugugucugucuguaucuauacacaccgaugggugugucugucuguaucuuuacacaccuaugggugugucugucuguaucuauacacaccuaugggugugucugucuguaccuauacacaccuaugggugugucuuucuguaucuauacacaccuaugggugugucuuucuauaucuauacauuauauguacuaaauaauauauauaaacacuauaguauauagaguauacauauacacacuauaguguauguacuauacacuguguacuaauacaguguauaauguauauauauaguauucaauauagaucuauaaacacacaagugcauacacacacacauuuuucuguauauauguauaaagauauauauaaagauuuuuaaauaaggaauugacucaugaaauuacagagacugagacaucgaaacccaggacaaccaaugguacaguucaugucugagucugagcagcugagaagcaggagauaaaaaggcaucaguuccauuccauauccaagucugaguccaagggcaggagaagcugaugucucagcuugaagucaggcauagagaggcaauucuuucucacucagccuuuuauuuuauucaggccuucaacagauuguaugaagccacccacacugggaagggcagucugcuuuacucauaguacuaaucgaaacguuaauguccuccagaaacgccuucauggacacacuagagauaauguuuaacauaauaucuggguauccuguggcccagucaaguggacacauacaauuagacaucauggugguuaugccaaguuuuuuuuuuuuuuuuuugagauggagucuugcucuguugccaggguggagugcaguggugcaaccuuggcucaccacaaccucugccucccagguucaagcgauucuccugccucagccucccaaguaggugggauuacaggcgccaccaccaagccuggcuaauuuuuguauuuuuaauagagaugggguuucaccauguuggccagacuggucucaaacuccugaccucaggugauccacccgccuuggccucccaaagugcuaggauuacaggcgugagccaccacucccagccagccaaguaaguuuuaacuuggaaacaaugagcagacacucgcaguacauucucuacuuaguauauuucuuuuucagagucaucucaaaaaucucuaggccaaguguucuuaacuauggaccuugaugaauggacccugaguaucuuagaaucuucugaaauaauaugcagcauuauauuccauuuguaccugggaagaggguacuugucuuucaucagagagucaccaauggaccacuggucccugcugauuuagugucacagcucaaaaccaucaguaguccucgugaucuuucggcauuguggcucccuuugugagaagggccuaagagugaaucucccaaccauaagcuguauucaggcaggcacgaagucucuuauuuacucaguguuucuggagcccagcauagugccucgcacacagcaagugcucaguggguaucuguugaaccggcaaaacaaacaaaugaauaaauuaauggguggucacuguacuaguuuucuauugcuucauaaacaaacuaucacaggcauagugaguuggaaugauggcucucaaaaaacuauguccacauccuauaaaugcuauuguacaauauauggucuuuugugauuggccuccuccacuuagcaucguguuuuugagguucagccacaguuguagcauguccaucucucuuuguguggcugaauaucauugcauuguauggauauaccaaauauuuuucuccuuucaucuguugaugggcauuuguguuguuuuuacccuuugacuauugcaaauaaagcugcucugaacauuucuguguaaguuuuuguuggaacaccuauuuccaguucuuagggauauguauuuauaucaagccaaacuaccuaccuaaccaccuaccugggaguggaauuacggggucauacaguaaaucuaugguuaauucaucaggaauuauuuuauaaauuuuugauguuggauaucugaagauaauacagaauggagcccuuuuuuacuuuacagauuuuuuuuuuuuuugagagagaaucuugcucuguugcccaggcuggagugcaguggugcagucaugguucacugcagccucgaucuccuggggcucaagccauccucccaccucagccuccugaguagaugggaccacaggcgcaugccaccacacccagcuaaguuuuguauuuuuuuguagaggcaagguuucuccauguugccaaggcugaucuuacacuccugggaucaggagauccgccugccuuggccucccaaaaugcugggauuauaggcaugagccacugcacccagcccuggauuuggcuuuuugaaacagggcugcacauaaccuccaugaugugauucuggcugugucuguugaggucccauugggcccagcucugagauucccuguuagcacagggucugacacaucacagaugaacaauggaucuuugguaauuaaaaacagagcuguguggcuauuuuucuccaacuccuuuuuuuuuuuuuuuuuuuuuuuuuuuugagacagucucacucuauugcccaggcuggagugcaguggugugaacucggcucacugcaacauccaccucccggguucaagcgauucuccugcuucagccccccgaguagcugggaccacaggcgugcaccaccacaccuggcuaauuuuuguauuuuuaguagaguugggguuuuaccauguuggccaggcuggucuugaacuccugaccucaagugauccacccaucuuggccucccaaagugcugugauuacaggcgugagccaccgcgccuggcuuucaaauuccauuuuuuaaaguuagugcuuuaauauguuaaacacccuuauuaacauauuacauauguuaauauguaaaauaaauuccguacauuuuaaagugcuaaagguuguauguuugugcgauggauauguuuaagagaaugauuuaggaugcgaucaguuuuuuuuccuugacuuacucucuuccuuuauuuuuuucccuucuucacuuucucuguuauuccuugccaaucucauaaauaauguaagacaacuugcaagacuuauuaaaugacugauuuccuuaaaagaaguacgucaggugaagggcagauagaggucaacaccauagauaaaucuuuacacuccaguggacuuugauucacaucauggcuccuucucuuccuugcugaggcuuuugacaauuucaaaugcucccugaaccucaguuuccuuugccacaaaauagcaauacaaauuuauaauuccuuagauugcugugagaaugaauugaggcaagguagguaaagugcaaggaauuguguguggccggccaggugcaguguggcucaagccuguaaucccagcacuuugggaggcugagguggguggaucaccugaggucaggaguucgacaccagccuggccaacauggugaaaccccaucucuacuaaaaauacaaaaauuagccaugcuugguggcaagugccuguaaucccagcuacucaggagacggaggcaggagaaucacuugaacucggaaggcagaguuugcagugagccagauugcaccaccgcacuccagccugggcgaugagugaaacuccgucucaaaaaauaaacaagaauugugucuggccuuugugauaguuacucaacaaaucauaucugugauuguuuugguuuuaacaauaaugguuuuuaaaaaccguaggugaucacauacuacgcagaaagggaagcaguuacagcauucacagcauccgugagucauagacucacugcauugcuccaaggugcagauucuaguuggaaauguuaaguuuuuuagagcaaugaaaaaauugaucucuuucucuuccauaacauagauuucccaucuagcuccugggcuaacuuuuguuuaguaguuguauuaugaaaacaccgaagaauccuucugccagucuccauagcagugauauaaaucagagcccgcaguuucaugaaugccucgcugugccaccaggauuuucuuggagggagccacggucagauuucaaguggucauuucacucuuucucccucugggggacugagacaugauuaacuugcaauaauugugacucccucauuaaaggagagcuguagcaagggaagaaaucauugagacugaucaagacaucccgugcuauuuuuuuuuucuugcauaucagcuguguggguaccucuuguuccucuguccuucagguuaguaaaacgaagaacaguugcugaagcuaugagcuaucgauaaaagcuaauguaccacacgaaauuggaaggggaacaaaaucacuuaaguguucagggccaccaaggcacuggugcauccccugugagccuauuuggcuccuggcgguguuuuuguugcccuggcuugcaacguagccugauuguucuaaguaaauggcagagcacgcaaaucaaggacauuggcaauaaaccaggaaugcacuguuuccagccacgggcuauccagggaauuggggacagucuguaauguaucuugagcuaggaccauauccaaauuacuggccuuuccaguuuuucuuaaaauaguagggucaguaggugaccacacucagaagccaagccugcagcaucagggcugaggagcaaacucuuucuuuggucugaagcuucaaauaugaacccuugccaccagcugcauaaauaugauagccaaaggguuucaaauuugugauuugucauaaacgcuccuauugcaggcugggucuaguccuucuugacuuuguggaaggagaaggcuugaggaaguauucacaauuggagaagggcgccuucuguuauguucuuagcucacuaaaagugguuaaugaugagaaggggugggucaaugacaagaaaaguggagaagaugagacagacaaaacugcaacucaucuucauggcacacuggugagugggggagugcaagaaguuuaggugcaaaggacaauggagugaacaucuuggcuugguuaacagaagaaaagaauaccaacgccgucuauuuucauaucccuuucuauuuuauguacauauuuaucaauauacuuuuuguuccagaaauaaaugggaacuuaggcacaaucuuuuacacaucuuaccucaacuggugacucuucauaaucuagagcuauuauaguuuccaauugacagauggggaaucugagacucagagaaguuaaaugauuuuguguguguguguguguguguguguguauguguguguguuuuguuuuuuuguguguguguuuuuguuuuuuuuuaagacggagcuuugcucuuucacccaggcuggagugccuuggugcaaucucaguucacugcaacuacaacaucccagguucaagagagucucccaccucagccucacgaguagcugggauuucaggugccugccaccaugccuggcuaauuaagugaguuucuuaaaguccuacaacuggugagcugugagcuguaaauuguggaacuaauuuuuauacugccaaucugaggccuuuucugaccucaucgcugccacuguaaaaugaauucuagccccagaccaugacaugccuacuagcuuagcucuaaccagaaagauuuauuaucccaagaguugugaaaauguggaagaacuagaacugucauucacugcuggugggaauguaaaaugguacaaugaauuuggaaacaguuguccagugccuuaaaaaguuaaacacacacauauguggcucagcaguucccuuccuaagaaccuacuggaaagaaaauaaaugcuuauacaaagucuuguucaugaauguucauagcagcaucauccaugauagccaaacgccggaaauacccaaauguccauuagcuggggaauggagaaacaaauguagucuaucgacacaauggaauacuacucagcaaugaaaaggaacuaacucuggauaccuuuaauaacauagaugaacuucaaaaacauuacgcuaagugaaggaagccggucauaaaagaccacauaguauaugaugacauuuauaugaaauuucuagaaaagaugaaacucuauagacagcaaacagaaugaugguugccuggggcugggagugaguggaggggauuaccuggaaaggguggggcaauuuuggggggucaagaaaauguucuaggacaagacuguggugauggcugcacaacuggauaaauauacuaacaucaaacuguauauuuacaaugguuaaaucauaugguaugugaauuucacauuaauaaagucauaaaaaaugaauuccaggaccauuaaaucaggugacugagccaauaguuacaggaacauagaaagauuuucacccauucuguauaauuagacaaauucuguuacuaucuguccaacaguuuagcaagagucacucugagauugaagagaggaagggaacguuggaaccaaugcugaugagccauucauaggcucuggcucacuauauaugucuaaaauucacaugccccuaacccucagauaaugaccauuaauaaucuggcaggagaggaaagaccugcagcucuucuaguccuuaugcuaucucauugucucauggauuuuuaauaugucuuugcaucccuuagaaauuugcacuuuuccccccuuuuuccauuaaaacacaccugcgugcaaacguccauacacacccauguacacacagacacacacacacaugcaugcgaucuguaaaaagucacaaaggccaaaguuuuaaaggaagaaaauaaaaaucaccuguaguccuaucauucagagauaaccacuguauguuuauuuacauuaguuuugauuacauuaguuuagaaugaaauuuuaaauacacuaguauauguaauuaaaauuguauauacguuuuagucaaccaucagcugacuuauucauguucuguggacucuguggugggugggguccaagccucccugaagcagaucucuauccugucacccugcuggaaaugaaacacuuagggguuagaaggggaucaaggaaaguccgagaguugguugugauuaucuucagucagaaagugccuacuuuuccaagcauccagacugcaaccuguuuuuccuacucaaaaugguuuuuauggauucuauucuuauuuggcaauugccuggacuacagucaccaacacaaguuuauacgcaagaagugcacacagcccucccucccagcucauccgguaacaauuuagaugaaggauguaaaauaggauucauuucaugacccaagucuggucaauugaaacagccgauugaagugcuguguugaaaaggauuuugacacugcgcaugggcucguugggaaagggugucaugauggguuacugauucugcgguauuuuuguggacguggggagugguggccuacuuacagugcaucgcccacucugauuuagaugagcaagagcugcugaguuguagauuucuaguuucuaaacaacaauaagucuugcucgcagauagccucuuagcagagccaaaagccagcagagagaagacucagcauuugcuuuggaguaaguuuguguguguauguuuaucucccuuuuacucaugggcucuuuuuucccaaauaacugaggggccagcacauuuggagaacaugggauuuaucauugacgucagugccuugggagucuauguuuaugugagcuuaaagguuuuggaagcugaaugacacagaucaaagucucuccacugaucugucuuccaguccuccaggggacuucuuccaucaacuacaaaucauugaucaaaguauuggucugucaccuguccauguguaaggccaggccuaagugcucugacagggcaugacucaauccucaaacaggaagggggaaauugcuuuccgucuccuaacccuaagauccuggauggcagguaaucugcuuccucaagauucuguugauacacauucaggacucugguuucuguuuugcuugaugacaaugacccaguuucuuugacuaaauaaauguauagacacacauuacuucuuuucauucuaagaaucauaaguuuuucaaacuuuagaaucacaagguccauuaaaggacaucuccccugaccuucccauuuuguagaugggaagacuaagguccaagcuugaaugaccugccaucauggggauaaccggaauugauacaaugucuugauucaagauucagagcucauuuuuucugugucagauuaaaaaaaaaacaaaaaacccuuacugaucuuuuaaauauguaauucuuccuccucuucuccccuugucucucuucucaccccuaccaauguaaucaguucuuuuuuucuuuuuuggagacggaaucucacucuguugcccaggcuggagugcgguggugcgaucuugccucacggcaaccucugccuccuggguucaagcaauucuccugccucagucucccaaguagcugggauuacaggugcaugccaccaugcccagcuaaauuuuuguauuuuaguagagacggguuuucaccguguugcccaggguugucucgaacuccugagcuuaggcagucugcccaccucagcuucccaaagugcuaggauuauaggcaugagccaccaugcccggccuaaucuaaucaguuccuuuaaaucugaaacugucugccugauucugguuuaccacaaccaccagagucuuaagugucccaauagccagggucucauagacucugcuuaugguuaauucuucuggggaaauuaauuucucgagguaaaacaaguuuuuaaauuauccccuauagcucauagaagcaauucaguaaauacuuguugaauaucaaaugaaugaacaaauggcauucuacauugaauauaguaauucccaacuuucgugaagguuguuuuuuuuuuuuuuuuaaugaggcaaucagggguaaaaacccccgcugcuguccuaagacagaaagaggggggauuuuuccccccauggcuucguccuuauucuuauaaccuguaugcacugcugaaccugcugaauaaccaugucacaguggcaggagagggacugggugaacuugagccucgaugccuggauuaaagccuuguaaugauguuugcaaagcaccagggugauaacugaaugguuggcacaggcuucgaugaagcuuguguccaccacaguuuccagugcuucugcaccuggguggucagaaaugaguccugugagacacaggugacaagaucuccaaggaagcaguucacgcuuggaugacucuggagcuguggugacaaucuaaauccuaaauugaggcuuacuaggaaaugcacuagguaacaggcucuagagaaauggcuauuaccagguugcucaggcuggagugcaguagugcaauuucagcucacugcaaccucugccuucuggguucaagcaauucuccugccucagccuuccaagcagcugggacuacaggcaggcaccaccauacccaccuaauuuuuuguaucuuuuuuaguagagagggguuucaccauauuggccaggcuggucucaaacuccuggccucaagugauccgcccaccuuggccucccaaagcgcugggauuacaggugugagcccccaggcccuacccugggccccuccuuucuggccccucaaccuguuuucuuccagccaugcccuagggagagcuuggcuguggccuugcagacccucucagaugccacucaacaagggccaacuggagagaaaucucuagucuagggcacaaaauuucugucaacccuucuaaccaguguuugaaguacguaagacguucauuuccacuucuaaugaggaauuagaggaacggauuuauaaaggaauucugguuauaauugcagguacuuuuagagacgaugucuaacagugcaacccauagaaccaggcugccuggauucaaaucccagcucugcuauuacugagaucucuaugagagcucagaaaaguuuacuuaauuucuccaagucucaguuuucucauaagaaagaugggcauaaggaaauaauguagggaaaacacuuguugcagacugaggacucaacaaaguuauaauuaaagcuauuacuaacgucauuauuaugaaaauagccaucuuuuuuuaaagaagggaguuaaaggaaagaaaugccaggcugagagaugagacagugaauuacagugggggauaaaggggcuguggugucacacaggccuggcaucuguggccuugaacaagugcauuaaucacucuaagccucaauuucuuuguuuuaaaaauaauuaacuaaaauaccuuagggcacaugguaggaauucaguaaaugcucacugucuuucucauccuuuugcuuaccucacauuugcuugcagccagugcucaaaaccauagacaggcaguguccccaaccacucccugcguuucucuuucuuugccuuccgaagcugccaucuuggugguuuuugaagcaucaacacuuacuucacaugcagaggccccuuuuauuuauuuauuuuuaauuuuuuugagacagggucucgcucucuugcucaggcuggaguguaguggugugaucucagcucagugcaggcuuggccuccagggcucaagcaguccucccauguugaccuccuuuguaucugggaccacagguauauuucaccaugccuggcuaaucuuuguguuucuguaaagaugaggucuugcuaugcugcccaggcuggucuggagcuccuggccucaagcaguccuccugcuuuggccuccugaaguacugagauuacggguguaagucaccacacccagcccagaggccuucuuuaaaugcuaguccuuuuucucuuccuccaucugggucuugguuccaugcguauucaguuugugaaaaauuugagucgugcacuuauuauguaugugcuuuucugcauguaauuaugcuugauaaaaaaaguuuaaaaauuuguuuuagauagagguuugaaugucacuaauuaccaacguguagcuccuaauuggaauuaagaagggacuagcuccuauuaucagagaucuggucaucacccuucaaguugacuaucuccuuaugcugauuuuuuuuuucuuuuaaauagcagcacaaauauuuaccaucuagcagaugugguaagaauguaaguuguucagccauuuacagcuuagucuuugggagauauccauucauuuuaaauacuuggagggccaggcacaguggcuuauaccuuguaaucccagcacuuuuggaggcugaggugggaggauuaauuggggcuaggaguuggaggcuagccuggggaacauacugacaccucaucucuauaaaauauuuuuuaaaacucagcugggcaugauguugcaugccugucaucccagcuacuugggagacugaggaggacgauugcuugaggccggaaguucaaggcugcagagagcuguuauuguaccacuguacuccagccugggcaacagagagacccugccucaaaaaguaaauaaaauaguaaaauaaaacgagauauuuggaaggcuauguuuuuuugccaggccaugugcuuagucccugggaguauagcgaggggcaaucacaggucagguccuagugucucugaagacuucauucuaguggccauugaaaauguguaacuacccacaguaaucaaguuaaagaaagguucuggcugagcacgguggcucaugccuguaaucccagcacuuugggaggccggggugggcggaucacaaggucaggaguuugaaaccagccugaccaacccugucucuacuaaaauuauuuaaaaaaaaaauagcugggcaugguggcacacgucuguaaucccagcuacucgaguggcugaggcaggagaaucgcuugaacccaggaggugaagguugcagugagcugagauggcgccgcugcacucuagcaugggcgacagagcgagacucugucucaaaaaaaaaaaaaaaagcuuccauuugagccgccaggaaaggaggcccugaguuggggaguugaauagagagcugcauccugaacagacaugaucuugggugagugagaggcuaggagcggagggaaagcagacgcaguugcuaaagcugucaagucccgcucccuuggaaugcaguccugguucugcuaccuccaacugggucgauuucaaaaaauuauggacuugucugagccugauguggugccuggccagggcucacugcagcgccugguauacaggaagaacuugauguuauucauggcaaaagaugucuggauggucuccacuacagauucugauggcaagugacuuaaagacauguuggcaauggguaguggacaaaaauugaaacaccuucaacugugucugugaccagaagauuuuuuucuuuuuuuuuuuuuuuuuuuuuuuggcugacugucaugacuuaguaaggccaucacagguugccagaacaucuacucaacuguuccaagcauaaccuccuacacaggccuucuacauaggaguauauuuggccaagacucaccacuagaagugauuuccacuggacuuuccuacagcaagugguaaaugaucccucagauaggcccaagagcuccccuucaagcauagagacacaacccugugaaaacaugcauuggaaccaggaaggccugcccccaugacuucacguugcauacaugccuuugaggacuuggccucuuaaaggaaucuuucaauauccuaugcuucugagaaaguuacuauuucauuugcagcaggacaacucaacaagcuagcucuuccugcccagcagacucgguggauucugaagagggucucgggcugacucucuacuucauggguuugaauucaggaauguugcaagauugcaugagauuaagccgcugaaaccuuucugaggaagagccagcucaaauuucaguguuggauguucaccgcuucuuuaggguucuaccacucccaguaaaucaaguaauagguuucuguuaaaaaccccagugugcugaucucaguggcagccaucuugcuuuguaagccuucucuagcuuuaugaugcucccaguauauaagacauuuccagugucuaguccaaauuaguauuucucuaauucucgagugucugaucugccuggcuagaaugauuaaaacaaaaaaauagcaaaucaguuugacaguccacuucauuaaguggaggacaguguuuugauugcuauuuaaucuguuuuuccuucugucuguucuuggcuauauggaauucacuuugccucucuucccgacucuucauaucccuuaucucaaggugaguaucgucagaaucccgguacauuucaccagccaccuuuuauagaagcuuagaaagauggaggcaaacccauaaacaagacuugguuuuucuaagccacaguggcaauuuccuagucgauuacaacugugucuacccuuucaacuggccugucaguguaggcucugcauguccuggauaauccuacaauuggugacacgguuauugacuuacagguuucuagggcaucucauucguuuuuuaaaagaauguuucuuccacacuuuuauugcuuaguagaaacuuguucuaauucuuucuccugauaccauuuagccuauuaguaccugggaauaaucacccucccuuaucuaguccuacagauuuguuuuguuuugaguuauacccacuuuaggucucccacccucucuuauuuuuauaaacaggcuccaugguacuauauacacugcagauggacagcugccaaccugcucuuuuugugcugaggaacucuagauauuucaacuaguuuacaugacuuucuuaccuacgcuaccuuauaauccuuuuauaaauuuugcuuuacguuuuaacaacggaaaacacuuaagguuuuuuuccuuucuuuuuuuuuuuaauucuuccgccagcuaucuuuaaaagcaguucuaaaacuucuuauuuuaauauuguacccauuguacuuuagucuaagugauggcugcuuauggccaugcccuuucuucugcacuuuggguguuuugucuggaauuuucucuccuuuccuuuugugaaaaaggaugaauuuuccaagacucuguuaugacagaaacucaccaguucucuguuguuaaucaacaaauagauugugaaugcuugacucuucuuuuuuuuuuuuuuuaaaggaguuucaaggguaagaucugcugucuugugaaugucaaagaaguuucucauucgccccuuucuucucucucccagugucuuuaauuuguuaaugcuuucgacuuauuuugcuuuggauaauuuucaaaguacugcuuucucuagagaucucuaaaaggcagaaguucuggcuauuaaagauuugccauucucagaacagcccaguuaggguacccucagguuauuuauaacuggauuuuaucucagaaaauuaacuaaaagaagauuaaccaaaaaucuaaaggaaaaugccuuaaacaccucaucuauuaugcugugcucaaacagauauuuucaucuuaacagcuuggcaaacccaguggaacgcucuuucuaguuuggggcauaaaauaagauaacacucugaauuccuacaggaaaucuuguaacucuacuuaaaauuaaggcauaaaguaggaaaauguguuuccucuguauagucuuauuacuuugccuguuaaguuaacugguuccuauuucugcugguucgaagagguccaggacauuuaaauagcucuucuagaaacaaauucuuuuccuuacaagcccugccaggucaguggguucaguaaggaagaagguuuuguauuuugacaauuccuucaucuguuaauuuagucagacgaggaaggaaacgagaaaaguuauuccuauuucauccaucuaagacuuuauaucccauuucaggcugauuaaaaggcaaaaucgucacaguaggacaccaaacccucuguaugcccugccugccucccccccucugacccgccugccuccccccugugagcuuuuuccaccuacuggccucuuguucuucuucagcuguuccucagacaugccagguguguuccugucucagacgcuuugccuuugcugcuccuucugccuggaguauucuuccacguagcaccaugagcuguucuucuccaaaaggcuuugcucaacugacacuuucucagugaagcuguuucucaccacucacuauaaaauggcagccugccucucugagccuugcacccucucuuccuuuuccugcuuuguauuccuuguggcacuuauuauaucacauagauacagacauagauguggacauagauagagacauagacauacaugaguuuuguguuuauucuccuauucucuagaagaauguaaguuuguaaguacugagauuuuugucucuuuugcucacuauuguacuucagggccuagaggaaggcuuagcacguggaagacaauauuuauuggaggaaugaaucuagaaauauccuuggauguauaauguccaacucacucuaccacacagcaacauagguaguuuuauauacauuuuauagcuaagcccagcagcccaaaaagcuaaaugacuucagcgcccacagauacuccuggaugagaggggauuggaaaccaggucuguucaauugcaaauccccucuugugccuuuuacaggucagaugauuuuguuuuuauaggcucuagcaggucccuucucuuugcgucaccagagaggaagauccccuaagacaaagcauucccuguaguuuuuagcauaacuaguacuggcucaguaaguauccacugggguucggaauacaacugcccugccucuugagcagccaugccugcuuccgagguggugcugcaugcuauucaggaggacagaccauggauggaaauccugagccacaacuccuuagccucaugacauugggcagaugacugagcuugucugaguuacaauaaauaaaaauaccaugcugaaugauggccuagcaugacauugggaaguacagacuuugcaggcaggccccuggguucaauuccugccccugucauugaguaaaguaauuaucauaacuuuggaacaaauugaccucucuaagccucaguuuauucuucagcuaaaugaggaugauugauaaucaaaacuauuuuauagggcuugggggagcaucaaaugaaauaacacauauaaaaggcuugguuuaaucucugaagcacauuggcacuuaauaaauguuaacuauaauuauauuaacaccuauuuuacaggguugcuaugaggauaucaugagauaauauguaugaagaaccuagcacacuguuuggugcaugugaggguucuguaaauguuacccauuuuauuccuuaauuuccuuuauagaccccuuucccugcaacacccaguagucuggcuucuauccugacaauguuagugaaguugcuugcuugaaauuuaccaggccaggcuuauggcuguaaucccagaaacucaagaagcugaggcaggagaaucccuauggucucuugaguccaggaguuugagaccagccugggcaagauagcaaaauacuaucucuacaaaaaaaugaaaaaaaaaaaaaaaaaaagccugucauagugguacaugccuauagucuuagcuauucaggaggcugaggugggaggaucgcuugagcccaggaauuugagguugcagugagcuaucauugugucacuacacuucacccuggaucuggaaggaagggaggaaaggaggaagggagggaaggaggaauuuacuagaaacaaauuaacuucuguaauccuaaguacuuguuaaggcagaaaaacgcagauaagaaaaucgaaguugagggcaaggagcucaucuuucacggucauagaccucaguugcaacaucuggaaaaagagcugguugggcaugccgggcaggcuuuugugacaauguaagagcaagugaagauugcaucucaguaugagacaccguaagagcuugauaaaugguggacccucugauguugacaacaugaugucaaagaugguguuugcuguuguuucaaaugucuuauuucaaauucccaauuaguuucuucaugccauaagggcaaaauccacaucucauacuuuuucaggaucugcucucacuuccccaaacauguaauaccacccuggucuucaaguccacucucaaaaaaaaaaaaaaauuuggccuuuggccucgugaccaccaaaucugauuuccauccaagaggcaacauuguuugugcuuagaaggaauuccuggcugggcaugaugguucacgccuguaaucccagcgcuuugggaggccgaggcaggcggaucaccuaaggucgggaguucgagaccagucugaucaacauggagaaacccugucguuacuaaaaauacaaaauuagccaggcaugguggcacaugccuguaaucccagcuacuugggaggcugaggcaggagagucgcuugaacuugggaggcagagguugccgugagcugagaucaugucauuguacuccagccugggcaacaacagcaaaacucugucucaaaaaaaaaaaagaagaagaagaaguaauuccuaacagucuggaaucucuagggucucugguauuauccuuuaguuuaagccucacauuuuucuaaacauuuugaaaucugguguaauggcguuagaugaccaagaauuuauagucaaaaguagauaaaguaaaagagugaaaacagagacaugauacgaguugaugauaccguaugcaacuugucaaacacuuacauuugugaauaagaaaacuggggucuauuuggugguuuauuucagagauguuggaucaaaucagacaucagaaaagacaacaguaccaaacgaagauaucuuugcuguauuugcaguuuucucucuuauuaacaugaaaacaccuuacauagauggaaacaucuaaaggcuauuuuuuauuuuauuuuccauuacuucacucuaaugcuuucacccguaccuguggaaauuagacugucaccugcuuuuagcauccuguuuucuuucguguuuguaaugaagcccuccgggaauuaugcgauuacaaaaaugaguuacaaauccucauucgguauacgaaaguauauagcugcuuuccuucucuguuuaaauagucuacaaaacaagaaauaauuagucaagcacuaucgguaauuaagcacauaagaugaacauuaaacaaacugcaaucuugcaucauuuugaagguagauaggcagguuuuugcauuuggaauccagccaaaaugcccaucuucauucccuuugcuccuuauuuauuauuggugagggaauucacuugccgaacuugcugauguacucuugcuggcgguccaucugagaguucacauaagugugagugacuauuuuuugacaacacuaccuuugggagaagaugguuucaaagaacuaacuguaucaaauggaaagacaauguguuuucccaacaugggaguauguuucuaaguugggaucaguucacgauucagagaaaugcucugccuucuugucuaugauaucagaucaggucagacguagguauaagacccugacuccuguuuuccaagcacuuuuuuuuuucauuaugagucuaucuuucgguccccuaaagcuucugguaauuuuuuuucuuuuuuuuuuuuuuuuuugagacaaagucucgcccuguugccaggcuggagugugguggcaggaucacggcucacugcaaccuuugccuccugggcgcaagugauccuccuaccucagccucccaagggagcugggaccacaggggcacaccaccaugccugcccaauuuuuguuguuguuguauuuuuugguacagaugggauuuugccauguugcccaggcuggucucaaaacuccugggcucaagcgauucacgugccucagccucccaaagugcuaggguuacaggcaugagccacugugccuggcccugguaaaauuuugucuacauaguuacugcugcccaggcaaaaucugaaaaauguuagucuaauuuaguuaaguuuuucuugcagaccagaacuucuaggaaacuaauauacagguuuucuccaaaauauauuuucaaggaaaaucagagaauaaaaguuuccaaugcauuuagacuagaaaauuaaauauucaacaaacaauuucggagggccaacuauuugccaggauccuugcuggaauagucucuaaccucaaggcaauugcugucuagcuuuaagaucaagaguaauugugacuugauguaagguaucuguguugcuuuguauuacauucuucuuagcuccauuguguuaaauacagauagacaauauuuguacaugauagguuggcucaccauuaaucacuuaagaaguaauagaaugaucaaugauuuucuuucuggcuugucuacgccaaaaugguucuucugcucaguugguuucuauagugauuuuauggauauaggcauuuucuucucgaauuagaagaacugacaguccaggcacgguggcucaugccuguaaucccagcacuuugguaggccgagguagguggaucacuugaggucaggaguuugagauaauccuggccaacauggugaaaccucaucuuuacuacuaaaaauacaaaaauuaggugggugugguggcgcaugccuguaaucccagcuacucugaaggcugaggcaggauaauugcuugagcccgggagacggagguugcagcgagccgagaucacaccacuacauuccagccugggugacagagcaagaguccauuuacaaaacaaaaacaaagaacugacaauaaauaguuuucuccguuuugugacuuauuuuuaauuauuaagaauaagugucauaaagccaauacuuucuaacauguguauaguauguuauaguuuucaaagucuuugacaauuauaccuagggagccaggacaguauuuguaucaucauuucauuguuccuggaaaacagguucagagaaguuaagcgacuugcccaaaauagcacagcaaucugacagagccaggauuaucuuccauccucuauuuuauuaccugugccucccauuaaaucauccuaagcuccacuacagcuggagaagguucuguuaacacaccauacaucuuuuuuuuuuuuuuuaauugagauggggucucacucugucacccaggcuggcgugcauuggugggaucucagcucacugcacccuccuucucccagguucaagugauccucucuccucgccucccgaguagccucccgaguagcugggauuacagguaugugcuaccgugcccagcuaacuuuuguauuuuuaguagagacagggguuucaccuugcuggccaggcuggccuuguauuucugaccucaagugauccacccgcuucagccucuuaaaauucugggauuacaggcaugagccaccgcacccgguuauacaucuuaaauauaaaguuuuuacaaugccaccauuuaaaaaaaaaaaaaagggcauuaaugcauuuagcaaagacuuccugagugucugcuuggucgagugacacaaacuggaacagagcauagccugucuuccaggaaccggcaccagcgaugucguaggcugagggagaagccacagaacugugagugacauguuucuuuggcugcucccgacacaaggaacugcaacuaaauugaaggcuugaggacaggaagcaccuuagcgguucgccuuucauuugagugggcccaggguccagaaaaggguagauauucaggaagaauugaucaccuuuuggaugccaccacacaugccuaggcacaaaauaacucagaaaacagugauaaaaguugugauugugguuguuguggaaauuaaaguagccuccccucuuaagcuuugugaacuucagcaagcuccugaacccaucuggacccucucucucaucaguaacgcaguaacguagagaugaaacccuaaaugccauccggugacauccuggauuagacccugaaucagaaaaaggacuguagugggaaacucgugaaauccuaaauacagucugucauuuacuuaauaguaacauaccauuuucauaagcauaccaugggcugggcaugguggcuuaugcccgaaaucccagcauugcgggaggcugaggcaagcugaucacuugaggucaggaguucgagaccagccuggcgaacauggcaaaaccccaucucuacuaaaaauacaaaaauuaccugagugugguggugcccaccuguaaucccagcuacucaggaggcugaagcaggagaauugcuugaauccaggagauggagguugcagugaguugagaucaugcuacuguacuccagccugggcaacagagcaagacucugucucaaaaaaaaaaaagaaaaaaaaaguaaugcaauaagcguaccauggucaugugagauguugacauuaggggaaagacaauaaacagcguggaggaacucuguguacucuguuuguaaguuuccuguaauacuaauauucuaaacuaaaaagauaauuuaaagggaaagaaaaccucuuuaugauaguaacaucaguugguauaaccauuuuggaagacuugauuuacauaggaucaaauauaaguauaucugauccccuagaaauuucacuucuggccaggcgugguggcucaugccuguaauuccagcacuuugggaggccgaggcaggcagauugcuugagcccgggaguucaagaccagcugggccaacauggugaaacccugucucuacaaaaauauuagucaggcauaguggcguaugccuguaguccuaguuacucgggaggcugaagcaggaggaucaccugagcccagggaggucaaggcuacagugagcugugauuaggucccugcacuccagcuugggugacagagugagacccugucuccaaaaaaaaaaaaaaaaaaaacaaaagaccauuuuuaagacuaugacuggucaaaaugugcucauacauuugccaaaagacaaguacaagaguguguuuagcagcauuauucauuauaacacacugaaucauuauucaugauuacucaagacaucugguaaaccacccagauaucuaucagugguggaauggauaaauaaguuguaauaaauccacacaagaggagacuacucaccaacaagaaugaaugacuuagaacuaaauucaacaauguggauuuaucuuacagagaugauguugagagaaaggaggaagauacagaggaauguauccuaugugauuauaguuacaaugaguugacuaaaaagcaaacuauuccuauuagaagucaggguagaggauggaugggagcaugaaguguccuccgucauguugcuaauguucuguugcuuguucaagcuacuggguguguucaguuuaugaaaauucauuuaaugacacauguauguuuugugaauuuuuuugcauguauauuuuacucuaacaaaaaguucauggacaaauacaaaaucauaucugacaguuguugagagaauuaaaggaaauaauaauaauauaaagcacaaucaaugcauuccauuuauucuucugcuuuucccaucaauucauguuacccagucauuaaugcauacccucugagaccccaccaagccaucuagcccucagcugugucacugggcaguuguuucuuccacugugcaguguuucguucuuaaccaacauggcaccccagguucaguggugagagugucacuggcaacuucugaaauaacaucucuguuaguuuguggagugggcuaaauggccagcccuucuacgagcucccucaugguugcgggggacuaccaaucacucucuacuuuuuuuuuuuuuuuuuaauaggucuugucauuuguaaaugcagaaggaacacugaaaaaaaaaauacucuugccuucuuccaucuguauuuucuuuacuaaauuauccagucuuauaaauauuugaauaacauuuggucaguauaaaaucuuuccugucagcucaguacaagaacacuuuuuggcuccugagaccacaacagucagauaaauuaauauugauuuguuagaaaauaguuuucacucugucuaaacaucuuauucugggcucuugaaccaaaauuaugaauuuaaaagcagcaaaauaguucuucacaguuuucccagugaaacuaauuaugggcagauugugagaaauguguuggaugugauuuccaacauagaguucugcuaaccaaaauucagagaaacuagagccucagucucugauuuauuugagcaaguugcaauuugguagacuggagaauuuauguaaauaguuuuugcaguuuccauagggauaacucaauacauuaauaucucacgaauggcagaagaugaagggggaaaguuuuuuuuuuaacugauaguuugauuuaccuaauagaaggaucggauucuucccccuucuuacuuaagucuauauauuaaagaacagcuggcuuaccugcuguauaaauaugcaguguguagaauuugacucaguuuagaguugaguuuuaaucacauccacguacagggauggggauggaauuuuuuuuuuuuuuuuuugagacagaguuuugcucuguugcccaggcuggagugcaguagcaccaucuuggcuugcugcaaccucugccucccaaguucaagcaauucucccaccucagcauccugaguagcugggauuacaggugcucgccaccacaccaggcuaauuuuuguauauuuaguagagacggggugucaccauguuggccaggcaggucuugaaguccugaccuuaagugauccacccuccucggccucccaaagugcucggauuacaggcaugaaccacugcgccugacuguacuuuuuuuuuuuuaaaguauacccauacccauuguacacauuugguauuuuuucuuuaaaaaaaaaaagcauuuacuuuuugccucaugaaucucugaguacauuuugugcauucuguauucuacuuuauuuacucaauauuaauuauaugagaaauaaauccuaaauguaauuuugaaugguggcuucacaaaagaacauuuccucuucuuuuggacauuugcucccaauuuuaaauaacacaucauugaacaucucuguacaaaauuccguaucugaucuucagagaaguuuuaagauagaugucuagaauuucaucucacaucuaaacuguuuuaagacacuugguacacauugauauguauuguccaauugcuuuccagaaacuauauaaaauauuacaaagaaaaacauauauauauauauauauguaaaauauauauaugaagggagaaauaaauguaaaugaaaagaaaaacauauagagaaagaauaugucuaaaagaaacugcagaggcagcuauaauuaaagcacaaggaaaggcuaugaaauucugguuccaccugcaacagcuguaugguaaaaagcuuauucagaguccuuccuucuuggaaagcuuuguuagagucuuaugggauugugaugcacagauacaggggcaaggcuacuuuuuccucgaacuaguucaccaaagcuucuauccuaugaaagugaauauaaaauucuuaaaguuuauagggucugcuggguuuaaggaggagaaauuugaguuuucauauugucagucucaaaccuuuucugaaauuggaagugaugaagugacagucuggcuauaugugugugugugugguguguguguguguguguguguguguguguguguguguguguguguguguguguguguauaccuagucuagggcuagguuugggaacuauuuucucccguaaguuaaacugaacuagacuguaugucaaaaaagagucucaaugucaacuuaauccauugucaugacuguaaaaugcuauuucauuauaccagcaauuccccuguggauuucuccugacucucuaugcagcccaacucuauuuuaaucuguuguagcuuuucuuuccccucucucccaacuccccacguuuuggaauuauucagugcauucgcuuccaaggcaccuguuugauauuuacacaaauuaugaaaguaaggugggaaggcaaugaaggcaacaaaguauauaaaacacacacacacacacacacacacacacacacacacacacacacacacacaagaaaugacuacagacaccucaacacccuuccaaaacacuugaaucauuuucuucgggaguugaacaaguggcugaaaaugccaaaauccaucagccaauguguaaguacaaaagggucagauaagauauauguggauuccauaaaauagugcauuugaauucccccaggucuuuuaaagauagugguuuuccagaugugacaaaacaaaagaagauuuccaaaucaaaauucccauuugccuuucgggauguugaauuuucuccacauuugugcaauuaagaguuuugcugagugagcuuaggacucugucucuuuaaguguuuaacaguaauugguucauguccugguguucauugaaaauccuagacauuucauguaaaaucuucuuaaugaggggaugaauuuuucauucacauuagaaagcucacucugacaaacaauuucuaaauaaaacuuuggcgacaugacaucccacauuggacuugucagagaggacaggugcauuagaauauaacuguauggcgauccuucaagcugucagccaugaauauuuuauuucuuaaugaaucaucuuugugaaaucaacuuucuuguuguagugucagugccauuuacaacaaaaagcuggcuccuuuuaaaaggugagcuccuuaaagaugcugauuccugcauaaaauguuuaacccuacccaagguguugggcaacugggggcuuugugcuuugcuucucccuucugaaagugacuugagaacccacuuugggcuagugugauuacagugaggagaaagcuuuccuugauuuguuguuuccuucucagaacugaaaucccagguaccugcccagaggcagcucccuuggcccuugggucccuguuguuccagguguuacuccuauucuuuuuguaguugucuagggauuuaguuucucacauccugagguccacuaggugcuauuagcuggugcuaacugacagcucuaggcagaaagccuuucucaggaucccagcuucccugucuuccagaacucaaagacggcuuuuguuuguuaguuuugaggauggagacagcugucauucuaaugaggacuuaaaugugucccugcugaccgagccagaacuuauuuuuauguugccacuaggagucuucugagaugcucuuguggcuggauguagaaucccuuugcucaucucuagacacagacuagacaacgaaauacauuccccuaaaauagcccaggguuaguucuaugaccuuugucacuguugguacaguucuaagaggauauugauuuuuuuuuucuuuuuaauucauagucucaacuaugucucaagacugcccagcaguauuucuguuuacucgaucuaauuucucuuccauuccucacaguggcaauuucaagcuucuccuuuuuccccaagccccauaaucucccccugaugcccuuagaaagcuucccuggucaguccuccucaccaccuccagcucccccuagaaacugaccauuuaucccaucccggcugacuucuucccuuuuacaagaagaugucucucuuugaauucaacucagaggucagcuucacugccugcccuguggagucgacucugugucccacccuucaggaauacggcuuaauaauaagaugauaaggauucguaccagggauuggcaaaugacagucauuuucuguuuccuuaaguaaaauuuuauuaaaauacagcuccacucauucauuuauauauuguucauaucuaauuauuuucacacugcaauggugcauagucaaaugcuuucuaucuggcuuuuuaagaagaucuuugucccucccccaccccccgccccgauuuauacuauggaucagcagccuaaacccugcaaacugggucccccaucuaagagucugcaaugaaacgcgagccgacuugaugugucucagagugaucauucuugcccuuggcgguugaugcuagacuguugcagcuucaaauauaauguauuuuagugcuauacgacagccauaaguauuggccuguguccacuggucuccacuaggagaaaaccgagccaagcuugaaaguacuaagcgugcccaggggaaauggaauaagcuagaaauuuguuguuuccuuuucacuagguuuaagugagaauauuugugagcaaacucucagugugggcaggugacaauuucugcagguauuuuccccccauuuuaacuugugcgauauaguucccuauuuuguuuuguuccgccucgaucacaacagcugccacccgagguuuaaagauacuguuguccucaucuucagaacaaggguuacguuugcuguaucuggagaaaguccauaguuuaugaugaauuuucuauuaauguaaacucccacuguuuauaagucacccaaauuguugguauuaaauuagauguguaccaucuuaugucucuucuuucagaaaaugaaucucuguuuuuuuuucucuuucuccuaaauguuaggaauuuucugaaguuugaaaccaaguggcacaaaaacauugcauuuauuacauaauugcuccuagggaaauacacauacacacacauguacacacauacacauacacacauuuuuuccuaaacaacaucaaugucauaacaguuuugaagcacauauacacacugacacauagauuuuguaaaugaggcacaucuauucuugaaaugcaauugcuuaaaaauggaaguucugaaaauaaauaaaaagaaacaucaauaaauaaaagccccauuuucauauucuuauuugaccucuugccucuccaucauucuuaaauuugaccuccaucauucuuaaauuugaccuccaucauucuuaaauuugaccuccaucauucuuaauccucauguucuuaauggacaucccucccacccuaucugggccuucugagacuguucccccagccccagucaggagggcuuguccacaaguugcugucugaacugggcaagccuccuggcuucccugaaauggugcugaugucuucacuuccugccaccuuggcaaccuuuguaguugcucucuuuuugccaggggaacaaauuaagagagagaagagugauagugucuacauguggucugcucacucagccaguauuuuccacagccagucuuucccuagaccagcaucugagcgugccuugucuaugggccaccuauacuauuauuuacugaugacuuccucauucacuuucuguuuuuuaucuaaaugccagccuuagccuuguucaagguaacaguauacaggaaaucauggguuucgagcauguuuugucaauauuuaguaaaaugcguucauagcuauuauuauaaagacuuuagguacauuccugcaccacuuaauaacugaaucaaucuccuuucaucagggggaacaaaccugucuuuggcucacacuguuugaggauauaaaaggaagcauacagugggccucauucugacaaauuuuuaguaaaucacagguugccuuuccuaaaucccucaauaugauggcuagucuguuucauagugaauaaaaagugauccuggaugaaugaauaaagugaaauucagauaauuuuucucaaaacugaaauuguuuaaaucuuccuuuaguucucuuuuuucugccugccccuucuuucauauacccuguuuuucaccucuuuugucucagucccaucugauauuugaauaacaauauguaauuucagguuuaggauuguugaucuguaaaucucagccuagugcuuucaacuccuggcuuucuccuaaguucacccuccucccuucccuccuuucuguaaggacucuaaacgauugcgcuucauuaaguuauuuuuauaaugaguuccuguuaccagggaauacagaguuaaaaaggugaucucacuaaaaguaauuagcauaagaccugcuggaccuguagaagugacuggaugguaaucaauagcaauaugauuacacccaugcagcaauuauaaauuauuuaaaacacuaccccuagguuacugacuaguugccuuuaaauuaaauucucugucgauaauugaugcaaagaauuaaugugagaacaccuucaguuacugcaacuuuuucaagguggcauaaaauauugaacuauugcccgucauuagcagcuaagcugucuguuugcucuaacauccuucuuuucuaaauuggucaagaaagagucucagaucuugaaagaugacaaaugauuucgaauccacugcuggguauucuucuaagagcacugaaaugucccagugagaaauuucauauaugaaggcaaaggaaaaaaaaauuaaacuuuaaauaaugaccaguuauacuucaucaacucuaacaaaugaaggagcagaguugguuuuccggaguuugcuucaguucuuugauauggucaguguaggucggggaggucuucccuagcuugagaaaucauaaccuaggauauuuaagcugucaguaauaguguuuuaaaacuccaggccuauaauaaaguaaaaagugugucugauaaaauggguuuuuuuccuugcuuagugaaugucuucuguuucucgcuaaacauugucacuugccaaaccauguuuucuguuucauacuaauuuucuacuggcagugagaccagcggaaucuaagaaauugcauacgaaauucaaggauuggaaagaagaagaggaagucaaccauuagcaacccuagcuccucuuuaaucucaagaggcaagagguacucgaugaaccacaugcuaaaauaaaaaaaaaugaaccacaugcuaaaaucaaauggcuucugcaccugugugcguuccuggacucuggggucacaggauggcugaugagaugccuucgagaaauuaauacucuaaugagggaaacauccuuucauguuggugcaagagacguucuaggccugguucuaccucuaguuggaacgguggucauggacaggucacccccgcuguccagaacacaugucaagaagugggagcuggacgacaacauucuuguucagagcguucuuccuccacauuuuauccaaagcagcuccacuuuuaccuguguuaucuacugagauucugcgugugugaaacacaaggucaccugccaaaagcaaaacaauuaggccagcauugggcuaggugaggauccauugucuuuugggcaggugauugugauacuauaggagccgguguccuguugauggcaucccacaacuuucuaaccucuguuguagaguuuuguuagccacgauuuggaccaaccugcaguuaggccaagggcugcugauccaauuggauuaaggaacucugcuguuugagcauguuggcuucauucauugguaucuccuacgccaaguccuaggcuugguuacaaagggcaaugaagggucuuuucuguccuuaagcacucacagguagcuuaacaguaaugccuuggauuccuuccuucaagagcgacagcaggaagcccagcuucucugguagcagagcagggguccucaaagcagaccgugaggucagaggagcacuggagucaggaguuuccaucuccacccugcugaguaaacuguaguuacccacacagaaaaggaggcucuccaggcugacagggucacaaagacacacgacuaugagauggaaugacuauagcuagaaaaaaaaaaaaguggggaugccccucuugaccaucuuaugccugaaauaagggaagacauucuucuuuuuuaucugccaaccucccagugccacaguaagcacagagucaggccucgaaaaauaccaguccuuucgccuguccccucucacaugguuugaauccaagaggcugucauaccaggcucccccauucaguauauuuucuuuauguuuaaauaguuuggauugacuucucuuuucuuuuauuuuucuguugcuacuuaggaaaccaucuccaggcuagaacaagugccugaaauagagaagggugaggucacugccuaagacacuuccuccuccacccacuccucucucagacucagcuccuuccacuucugcccacauggcugccauuuuaauuuuugcuuaaauguugcagccaauauuucauguauuguuguuuucuuccuugccugggagacucuuuugucugagguucccugguauuuuccaggggcccuucuagcacuucugugaacucauuagcuuccccuuguuccagaaaaugucugucauacauuacgugccuuucucugucuuucccugccccucucaccuucaucgaucacacuuuugcuucacagagguaagaggaaaucacacucacacaguaucuuuuguuuucuagcaagcuagaacacaagauuuucuagaugcaucuuuugaguugauaugcaauauuuuccuugacagauuuguuaccagcugagcagauauugugucugugauguauuugaguaccagguaucccugauuaccauagaguaaugucuuuuauugaggcuuuuauuauuauuauuauuauuauuauuauuauauuuugagacagggucuugcuuucuugcccaggaaggagugcaauaguguagucauggcucacugcagccuugaccuccugggcucaagcaauccucccaccucagccuccugaauagcuggagcuacaggcaaguguacuguggcaauuguuaauguucacuuuuauuuccauaguuagccuugaucguuuaguuuuaaagaguuauacaacacauacacacacaucuaauuguuguguuauuggguuaaugggaauauuuuagacucaagccugguucuuugcuucucuccagcacagcaaaggauacaccuccaaguauaauauugaacuucaaaguuaguaauguucagugaugcuuaagcauguagaucauaaaguccuagacuauuuuuugucuaaauuauuguuuguagucagccucucuacugguuggaaacacaggcuugaguuuggcuuucugcucuaccuaguucauugcugcagcuguaauccagccugauucuaauuuucaacuggagaugguugucuucuuuuuuauuccaugaaacaaauugauuaaugugucgagggagcaaggugguacuuauaccuacccagccugcuugugugugucucaagguggagagaggcuguggaaacaauagagagaauagcauggaaggccacguugcaauuaaacaagauugggaaagaagacgggacuaaaaucaugccuugaagauguuuaucauaugaaguugaccuugagaccccaagaccggcuucaguuuuccacaaugcggcuauuaugagaaaaacagugacuaacugagcacugugcauaacucaguucucggaauuuucaaucagaaauuaucugaugacgggacuaauucuuauuacgauaguuccaauggauccacccaggauccaccuccacaacuagguguacagaagcuggagaucccaucaugccgccgggcaccgguuuacgagaacucuaugucuuaucuugguaguacgauuaggaaaacaaacacaaugguuucugccuucaauguuuccauggugagggcaguuauuaggcauaugcuaaaguguaauauccgcuuuuucaaaccacauuucaaaguugauagcaucaacggcuuuaaaaucacuuuuaaagaaucugggcuuacccaguuaacagaaauagaaccugccuguuuaucaguggguuugccucacuuuucuguggguuucuuuucuuuucuuaauuaugcauuaagaaaauaacuuaaguuucugugcauacaacaucuuccuuucucauucccaguacccuagaaacacagccguucacugaagaggauuugaguguugucuccucuguggggucaaaacaucaugcuucuuucuguucugccccauggcaguggugacgauggccuagcuuccaucccguagcuucuuguguuuuucuauuccaccagucuaucaacccuguauuuguugucaaauuuacacuguccacaggcaaagaucuauucuccuuuagaauuuaauaggaggguuuggaaaugaugccauggaaacccugagcagcuuggcaaugcugaccccaaaugagaaauaacuaucauugguguuuuccuucuacuacuauuaucuugcccauugaucuucaaaaaguucauuggucaaauugauugaggaacgcaagacuuaaauguaauauggcucuggcaaauucugagaugcuaacaaaaacaaguuuucuuaagaacaaugucaacugacucacaguauccgacuauauaaagucgagugcucucaugccaggaagcugauacaguucaugaaaccucagucauucuuucguauuacuccugucuucucuuuggaaaacaaucucaugaauuuggucuugacgcugacuuaacaucccaggaaacagauacucaauuccacugucuuuuuugagaaaugaacaguucucaaacuuuguuuaaauuuccuuuucacagaugaguaauaaccaaagauauuucugaaagggcucugaaaacaugcaggcaauugaucuuuaaaaauaagauagaaauaguagguuuuauaaaagaaggaaauagaaauacuucagaagaaauaaagugugcugaaucauguuuuaaacauaauuauauccggaaugcacuuacccauuugaaaaaaaaaaaaagucaccaaguuguuuccaauuguuuuuguaaauuugcuuagucauuuucagagacaaaaauuugggaaaaggauuguagaaugacuggcuucccaaaaccacuugguguuuacaaaguuaucaaaaacgggcugggaccacugaugguaauaacaaaaccuggggcccugaaucguguauucuacauccguuagcacacugaagccacaccgcaaacuugugaggccagcguugcuuccccuaccccuuccgucaaaaaccgucugaggcugaucauuaacuugcauaaggucacauagcuaaugagaagcaaacgcaucauaaugaccugggacauaugacacugaagccuacucucuuuccacaaagcuugauguacucagauaguaauuaguaaacauuuucauaaauaaucuuaaccuuuucaagcauuuuugucgauuggauuguagcacucaaaaguaaggucuguuuuacuaauauaaaauugggccuguggaauaauucucuucacagaagugugugugugugugagagagagagaaaauguauaugcauacauauacauauauuauugagacauaauuuacauaauuuauguucuauaaaauuagcauauuuuaaauauacaguucucuggauuuugaaaaauguauacguguacauaaucauggauccaccaccccaguuaagauauagaacauuccagggccagguucaguggaucaugcuuguaaucgcagcauguugggaggcugaggaggguggaccacuugaggccaggaguuugagaucagucugggcaacagggugaaaccccgccuccacuaaaaauacaaaaaaaagaaaaaaaaaaagaaaaaaauagcuggccauugugacauaugccuguaaccguagcuacucugguggcugaggcuugaguaucgccugggaggcagagguugcagugagccaagauggcacugcugcacucuagccugggugacagugagacugucuuuaaaaaaaaaaaaaaaaaaaaaaaaaaccaaaaaaacaaaaacaagaacauucccaucacgucgguaaguaucucauucuccuuuccaauaaauccuuuuauucccagaaacaagcauucuuguuucaaucauuguaacuuuguuuuaccuguucuagaacuucauuuaauagaaaucauaccuacugcuuuguaugugucgucuucugcuuaaugauucacauaauguuuuugugauucauccauguugauggguguauuagggguucucuuuuucaaugcuggauaguauccuguggugaaaauacaccacaauucgcuuaucugugcaccuguugaugagcauuggguuguuuauauuuguuggcuauuaugaauaaagcuaccacgaauauucauaaauccuguauacauguuuuuaugcccuuauguuuuuauguauuuuugauaaauaccuaggugugaaauuauugacucuuaguguuuaacuuguaagaaugcugccaaacaguugucuaaaguaauuguaucauuuuaaccccccgcuagaaguguguaagaguuuauguugcuucacauccucaucagcacuuuguaauuucagucuuuuuaauuauagccuuuuugugggugagaaacgcuaucucuugcuaguuuuauuuugcauuuuccuagugacuaaugccucuuuuuaugaacucauuggccguucauauauuuucuuucugugaacugcuuguuuauguauuggccauuuucuaaaaauuagauagucuuuuuaauauugaauuauaggaauucuauauauauuuuggauacauucuuuuuuuuucauauguacugugaauuuucuccuuugucuugucuauuuauuccuuaauggugucuuuugaaaagcagaaguuauaaauacugauaguguccaauuuaucuuuuucauuuguguagugcuuucuuguucuaagaaccuuuaccaaucaccaggucacaaaaauauuuuccuauguuuucuucuagacacuccauaacuucaaucuuuacauucagaucuauguuccaucucaaauuaauuuuuguauauggugugagguaaugguagagguuuauuuuucucuccauaagacucuccaauuguucuagcacuauuuguucaaagacuaauccucgcgcuauucaauuuccuuggcaucuuugucaaaaaucaguugacuauauauguguggguguauuucuagacuguuguacuccauugaucuaauuuuuuuucuuauacuuacugcucgauugccuggaagcuagguaauaauaaggauucaaacuuuguucuuuauuucaagauuguuuggguuaguuuagauacuuuccuuuuacauauauauuuccugaucagcuucuccauuucuuuuaaaaagccuugcugggaguuuauuugcuuugguauugaaucucuugaucaauuugaggaggaucaaaauccugaaaguguuaagcguuaccauccaugagcaugcaucucuccauuuauuuaaggcuucuuuauuuauaaacauuucagugauauuugaugauuuugaauguggaggucuuauacuuuuuuguuaaauuaacucuuacacauuugauuuuuuuaugcuauuguaaauggcauuauaaaauuucuuuuuuccaacuguuuguuucuaauauauagaaauacaguugauucuagcaaacugcucucauauccugugaucuuaaaauuuauuuauucaccuuuuccuuuuuguuaaauagauucuguagaauucucuacaucucugaauauaguuuuacuucuucuccaauuuuuauggcuuuuguuucuuuuucuuguuuuaaugcacuggcuauagccuguaggacaguguugaacagagguuuugagacagacaucauugcuuuauucaggacuucucuauuauaugugaugcuaguuguauguuuucuguaccuauacuucauuagauuaaggaguuugaauuuauuucuaguuugcugagaguucuuuuauaaauguguucauauauauauguuuuauauuuuucuuauucuuacuaucugcauauuagagggaguuuagcucauugguuaaaaggauuuguuccggaaaccuaacuccaaaucuuugaacuuccuagaaaccuggccuguuuauuuaccccguaugucacuuuccuuuaucuguaacuggaaaauguguacgaagagcuuaauacaaugacugauacacagugaguucuccauaaauguuaguuauuauuuuaauauuacagcaucuguggaaacaguggguuuauauuucagcguccugagaaacacucauccugaacaacgggaacauuggccacauccgccauugucaauuuuaaauaaaagauaugaugacuaguuggugaguugaucuuguaagacuuuuacagauacccagaacggcucuacuucuucauauuccacuuuuuaguuuuaaaaguuuaaggagaucucugugaucccugaagaauugugugcaaagcagcauuaagacgaaaaucuuuuauauuuguguuguagcuuggaaaacuagcgcguggucuguuuuguuccacuggcuccuaagguucagguauuaacauaaauacagcccauuaacacuuguuccucucugucaggacauaaauuaagucugcagguguuccaugaagcuguacccuugguacuaauuaagccuugauaauuagguuuguuaaauucaggacuuuaagcuuauauucccuccuugggcuaccaaaacggagaugugcaauauacaagcccuccugacuuuuuuuuuuuuuuuuuuuuuuccugcagagagcguugcugcuccuucucuauuuuauuucuuuauuacuguuuuuuuaaaugaaggagucaguaacaaaccguucaucauuuugccagaguaggguguaaaccuucaugcagaccuguacauuuguuuaugacgagauuaaagucuuuucuccuccuguuuugugucagcucagacacugaaggggaaaguuuccagccugguuucuccauacacugaacauguugaaaucuaugccuuaagcccaaaugagcugucacucaaguaugcacgcucauauuauuaaaaacugugcauguaauuugcugggcacccaaauaauuuguuuuuuauuuuuccuuaaaaaugagacuuucuguuaggaaagugauucaugaaacagugaagauccugccucacaacuuucaagaaacccacagaggucccuauucacauaagaauuuucuaagcagagguuccaauuuggauauuucguggccuucagguuauuuguaaccaguacacaaaccacaaagucauaaucagauagauuuucuuuccagccugucuuuccucuuugguugcuuuguaaaucuauuacucaucagaucauauguuuggcaaaugccacuuuucauuuugaaucaauggaaucauaaaaaacaauucuacuaguaccacuuucaagaauauucauaguggucaugcuaacguaauaaccucucuuuuuuauuugaaggauauuaaauaaaauuguacuuuuaaucagagccuuuuuuugaaaaaaaaaaaaaagaaaaagauaguugauauugugggagauggcuacaauacagauucaucccauauucucuuuaauguucuauucccaagaagagcacuaauuaaucucucuagaaggguaccacaguuuccaugagcguucauauuuugaaguuuccaagaacauguucuacagaauggaccacugcucucuuuucagacccaacccuuguaucagaguuugcacacaucuagaaguuccgguucucccagucauuaccuuucuccuucaagcugggauucagaguccauuuucauagggcaaaaugcagaguucggguuccuuccuauccaugagaguaggugcugaaggagauaaaggaaugaagacauagacuuugaaagcaauagucuggcaaucauccaaagguuugugggaggacaaaagaucacaaaguauguguuugugaaaauaagacuaugucaugaaagcuuuagaauauccaacacauuauagaauauuuucacggaaauauuucggauggaauuuuggcuuuaauucuuucucuuuuuuuccuguucuuuucccucuccccacaaccacuucuguuucauuuucuguuuugcuccuucuuuucauaaguagcugguagucaguguucucuuuuucuuccugugagacaggaucucccucuguugcccaggcucgaguacauugguaggaucuugguucacugcagccugugcuucccagacucaagucauccucccaccucagccuccugaguaacuaggaccacaggcaugggccaccacgcuggguuaguuuuuguauuuuuuuguaguaacacgguuuuuucauguugcccaggcuggucuugaacuccugugcuuaagcgauccaccugccauggucucccaaagugcugggauuacaggcgugagccacugcgccuagcgagguagucaguguucuaaacacugguguacaauccaagucugucgcugcccaggauagaggagggaugacgugaauucacacgggccucuccuacaaaucugaguguacaucaagugaggggcgucccuccgcaccucacuguugggcugaucaaucccauucccacuccauuauguguguauuucuaaguggcagauuugccuuaggaaauggaagaaggggaugaaauagugaccaacacaaauuacuggguuggcgggaguugagagcuggcaaaaucgucuuggagaaggaaauggugcagauuucagagcuggcagacagcaucuacauccaccucugcaggaagcaagggaaacauuuuucuucuggagaaucgggcagccugcagcugauccgguggugucugaaaccauccugugugcuguagugucaacaacuuagccugguuacuuugccaccaaaccccaccaaaugccuuuguaucuuuuucagaacugcaucucugcagcauaauugauauuacaggaaugaaaaguguucugaggcauauuauucccaggguaaagagucaccgcugauuaauuaccucaaggacaaggggacggugacuuuuucucuuguauccagcagcgccacgcggggcgggcgggagaggcaaggcuaagagguggaugaaaggcuaggguuaaggcauuucacaaugucaggcaucuuguuagacugcggcuuuccaggccuucccccgugacugcugcgggggccuaggccaaagauaugcccgaguagaaaaucugacaccagcuucccaguuuucucuucugcucucuuuggcugcaacgcuuuuaccauggguaaaccauuaggccggcucugcagggagggcaagaccacagcagcucaguauuuccugcucagggaaaaaggccaggucuuuuguugguggaaauccacuuuuccauccacugucuucuaagaaugaaaguaaaucuguugugcuuuccucugcccuguccucaggcuuagccuuagugggccugguuuuugccccccuccaguuuuagcuucccaucuaaaauacaagggaaaagacagcaaggacaggacacuuccuccuagugucuuguaaagcugcaagggagucgcggcugagucgaggauccacauuccuggaugaguccuuuuguuaccagcggaggguguccggguucuuggcauuuugaagaaauaguuggacaaaaugcacaaacaaagcaagagaagaaugaagcaacaaaagcugagguuuauugaaagcaaaacuacacuccauagagugggaacggcccaagcagccacucaggggcccuggauagagaaucuucuggagucuaaauacucccuagauguuucccauuggccacuugggguacaccccuuauaaaugaagugguggccugcaaucagucuuauugguugcagaaagcaaccaaucagaggcugaagugaaguuacaaauaucacacuccuaugcaaacaucugauugguuuuggaaagcaaccaaucagaggcuaaagugaaauuacagaguugcucuuuuaugcaaacgaagacuccgccuccagucaguaugauugguugugggcagcaacccaucagaggcugaagugaaguuacaaaguuacacuccuaugcaaacgucugauugguugcaaaaagcaaaaccacucagagguacuuucaauuucccaucugcccugcagaaaagguaagggguugcaaaagaguagccccuccuccuuuuguuacuuaggcguggaaaguuaaggguuuccuuucaguuugguucuaagaagucagagugaaauggcuuuagauucccugccugcagauucuauuccccagccucacuuugagaagcaccuggacacuucgcucuaggcacgugucuucuucaagcugccauccauuaugcauaguacaggagcucagaaaagucacccguggguuccuuucuagcucaaucaugcugagaguccaguccauuuauaacauaauucauaaaggaacauucuauuuaguucucagaacucuguggcaggggacuguuguuauuccuccuuuacagaggugggucugaagguacagaguggauaagucauuuucuccgggccagccacacagcgaaugaauggagacuccuuguguguaguaaauggcugcagcccuauaagcuauaaucauauaucaucaacaccuuuacccuguuauuaacgugucugaaauuagggaacaccacguacaaaagggaucaggguccaccuuucugaagaaaacugcagagcuuuugcaguuauuaaacuagcaacagauguaaaguccaacuguuagaguuuuucuuuaaagcagaaguuagcaguuacaggugcuugugaugucaucacuuagaugaucuuauaaaugccuuuuuuuuuuuuuuuuuuuuuuuuagucggagucucacucugucgccaggcuggagugcacuggcaugaucucggcucacugcaaccucugccucccggguucaagcaauucuccugccucagcguccugaguagcugggacaagaggagcacaccacugcgcccagcuaauuuuuguauuuuuaguagagaugggguuucagcauguuggccaggauggucuucuucucuugaccuugugaucugccugccccagccucccaaagugcugggauuacaggcaugagccaccggccuggccauaaaugucuuuucuggguggggcauggucacuggaaauguaaacccucccuuccccaggucagccugccucccagguguuggugcuaugauuacagugaccacauaauuuaucauccacacuggcaccuuuuugagagagguuggggagcagguaauuaugcugggacaauaggcguaugucaagauaucuggucacccuaucuaugaucugucacacuuaguacuuucuaaaauucucgggccuuugcaccuucuuuuuaucaacacuuaguucuauguuacugaauauuucuuaauuaagugcaggaaagaaaauaaccauuuuuucuccuuuuaaagaagcacacacaccuuucuuuuauugguauuacauuccuuuucccaguuggugccccuguugguuuuccaaauugucuucccauccuuauccuaccucccaauagaguaccucauccuauaguguuauuauaacuacagaaaauauauuuucauuccuuccacuucaugcuuucagcuagaaaugugagucucugagacuuguauucuuggggucacuuaaaacauauugcauaaugaggccuucaaugacucugauuuggaacugacccucuaugagggguuauaccccuggacaccaagcugcuggccugagcaugagguugauggccaaucucaggagaggaggaggaagaggaggaggcggagaagaaaauugcgugcuaauuucaguuguauauugagcccacacauauuuacuuccaauaugaagcaaaucuaagaaaaauucugcuuuaaagaaagaaauguaaaucaagugacuguugauggacgcuuggaagaauucuuauuuauuuauuuuuuuggacaggcuuucacucugucagccaggcuggagugcaaguggcccaaucauggcuuacugcagacucaaccuccugggugcaaguaauccucccaccucagccuccuguguaguggagaccauaggcauguuccaccacaccuaguuaauuuuuuauuuuuuguagaaauggggucucaccauauugaccaggccggacucaaacuccgagaugcacgugaaucuccagcuguggccccuuccaaagugcugggauuagaugcaugagccaccuggcccagccagaauccuuccauuaauaaaaggauggaccaugaacucccuuuuaugauaugagccgaucaaaugugagcagaauaguauccuauuuauacaauguaguuuaaaaccaacuucuuagaaccaugagcuaagggggaaucuggauuucaaaugcuaguugcaucaaacacguuuccacccccucaaaacguggcccaaagucauuagugucggagcacccagccauccuuggcuccuucccaccuauguugauuaauuaaaggacccaagagcuaaaagggagaaguagcugcaugcuugccacuuaguaauauuuugauaaguauuuuugggaugaaugcaaugauggaugaaugaaugaaugaaugaauaacauaggcuacaguauuuugucuucuugguuagggaccuugaguaaacugaggagucugaggggaaugccauggaagucuguaaacccaaaauccucagcgaaaccucagccaucuagggacaucuggggcagcagagagccacugguguggugaguuaucucccugggccuugagauagccaugcuguuuugucuccacaaggaagaaguaggaggcauagcccaaggcagcuugagaggaaagccucuuggccuugaauaagaugacuuuguuacugggcaaagaaagcccggcuggaagugcucuuugauaugcaaauauagccugauaaggauuuccucuccuuccuacuuucccuccccaacccucccccaagcuaaaauucucuucccaggagcccugucaucagcagggaguuuucugucuuuguccccaucucuucacuugugcugugcaaaaucaggccacgauugcaggguaguccacggcuuccaaagagaacugcauaaauauacaucuuucaggggaagagggagaaccuggagaagucaggagagcaaaaccaugccagucagcuucagugaugauaaagguuacuguuggaugaaaguuugcauuuuguuguggugugggaaggaccuuauccugucagcucuauggaugugcccaguuuaagcucugaaaguuccuuuaacuugaaauuguuuuugaucaugugacaaggucuucugacccuuuaucacccacaguguuuuauucauuugcucuaaaccagcaguaggugaaguuaggaauaauaugucaagcuuccuaacuccauggugcucucauuguugugugugugugucugugaauaaacacggaaauaauuacgcaaauaagcuauuggcagguggugauaacguaaccgcccaauggguucauucugccugaugcccagauaaagccgauuuaucuagacaggggaauugcaauagggaaagaguuuaauguugguagagccagcuaaacgggagacuggagcuuuauuguuacucaaaucagcuuuccugaaaauucagagacugggguuuuuuuaaggauaguuuuguggacaagagaauggguacugcugaugggcuguggaugcaaucauagggguguguaaaacccuugugcccugaauccgcuucuggguggggggcagggcacaggaccaguugaauggggauggggcuaccaguccucaaaaaugcaaaagccggaaaagacauuucagaaggccaaccuuagguucuacaaagugauguuaucugcaggaauaauuggggaaauugcaaaucuuguaaccucuggaauaauggcugcuaaucguuuauguccacucuuuagcagaauucaggcuccuguccuccuccuaacuugguggucuuuugcuagcuuuacaaaggcaguuuaguuuggggguagggccauuaucauuuaaauuaaguacuaaauauccccccaaaguuagcuuggcccaagcccaggaaugacuaagggcggucugaagguuaaaggcaagauggggcuagguuagaucagaucucuuucacggucauaauuuucuuacucuuacaauuuuugcaaaggcaguuuuaauaacugcuauuuagcaaagacaguuggguaaguuacuagagggaguauuaccuuagauggggccaggaggguuucucugaggagaucccauuucaacagaucuagaaauguaauggagccaguccuagggaaacaggacuaccaggaauccucaccagccccgcaaagacgagggagcagcaaguuccaaagcccguggcaugucaagggucgaugaauucaccaacugcaaggggcuuuggugaccccagugaacagaugagaaaggggaggaggcugggaucagugcacagcuuugcaggcuuugggaaggaauuucgaguuuaucucauuuguccagguauuuggaugaagcccuggcauacuaaccguaugaaaguuuauaguucccaaauugcaggauaacaaggcucuguaaucuucauuuccucaaaguuuuacaccaggauucuauggccaaguguguggcagugucacaacuuaagagccaguguaauugcccaacggguucuccuugcccgcugccuaagcaaagccgauuuaucaagacagggggauugccauaaagaaagaguuuagguccaggcacgguggcucaugccuguaaucccagcauuuugggaggccaaggagggugguucaacugaggucaggaguuugagaccauccuggccaagguggugaaaccccaucccuacuaaagauacuaauauuagccaggcguagugguaggcgccuguaauccuagcuagucgggaggcagaggcaggagaacugcuugaaccugggaggcagaggcugcagugagucgagaucacaccacugcacuccagccugggcgacagacugaaacucugucucggaaaaaaaaaaaagaguuuaauucaugcagagcuggcugugugggagaccagaguuuuauuauuacucaaauaagucucccccaaaacucagggauagagauuuuuaaggagaauuuagugagaagagggucagggaauggggaguauugauuggucagguuugagauggaaucagggaguugaagcuggccucuugcacugagucaguuccugggugggagccacaagaccauaugagucaauuuauugaccuggguggugccagcugauccaucaauugcagggucugcaaaguaucuaaaguacugauguucgguuuuaccauagugacauuauccccuggagcaauuuggggagguucagaaucuugcagccuccggcagcaugacuccuaaacccuaauuucuaaucuuguggcuaauuuguuaguccugcaaaggcagucuaguccccaggcaggaagguuguuuauuuugggaaagggcuguuaucaucuuuuguuucaaaguuaaaccguaaacuaaguuccucucaaaguuaguuaguccuacaaccaaaucaacuuugaacaagacagccuggagguuagaagcaagauagagucaguuacaucagaucuccaucaccuucauaauuuucuccguuauaauuuuugcaaaggcuguuuuaauaacagccagucguucauguuuccuugugccacgugauuauuuuguacagucaacauuaagagacaggcacuuguaaauguugagaugccaagggggaaagaauuuuagaauccagauccgcuuugguaagaguggccuucgagccucauguauucucuguucagcuguuaagauuguuauuaaacuuuauggaccauaaaccccacagaaacaaggagguugaacaaccaugcuauuacacaagugucaaaacaggagcuguauuucauguccugaaaagugugcacgguuggccuccucuaggucccacgugccuucuggaugguuuuaacccucagccucucuuuggccugugagugaaacccaucauuugacacagaggcuuucuggaaaugaugcuccucuuagaugaaaguucccuuucagaaaucuuucauucccugaccucuguguccaucccacuaauauauuucuuaccaggaguacauaguuuguucuuuaagcaaaaccauaugcaucguauuuuaaauggaacagggagguuguuccaugcgucaacuuaguccaaauguagagggucaggaaaacagugauaugagaaaagggccaguuacugucugggaauccauaaauacugcuuggcaaauggcacauugcaugcuuauuccuuaggcauccguuuagcaaaauaagaugucaagcuaauuguaaugauauuucugggguuucaucuucucucccugguacauaaaagaaugcaauuccaccuauauuuugauuuaagaucaaauuuuugcaaaguauaauuacauuugauguaauugcccaugcaacccagaugucauauauuuauguuauuauuaucauuuuucauguguagauguggugaucguuugugcuuuguuaaauauuccucgucuguccuucuggggaugaugcuuuuucucccuuuuuggucaggcauagauaggugacuugcuuuagccaaagaagcaugaacugucacuucaagggggagauuuacaagccagugcagguggauucccugcuuucuccugacaucaugaucauggacucacaugacaaaauggauccuccaucuuccagcaucucugauugagacuaacaagggcccugacagccuuuucuggacuuguaguaugugcaagaauuaagcuuuuucuguaucaagucaccguguuauggggguuguuccucacugcaggagaaccuuguucauccguauuagaacagugugguguuucauguuagcagaguguaucaggaucuuuuguuuuuuuuuuuuuuuaaauuaaggaugcuguaugagucuuuucucauacuacugagaaagacauacccaagacugaguaauuuauaaaggaaagagguuuaauggacucacaauuccacauggcgguggaggugucaccauuauggcagaaggcaaacaaggagcaaagucacaucuuacaugguggcaggcaagagaacuugugcaggggaacuccccuuuauaaaaccaucagaucucgugggacuuacucacuaucacagaaacaacauggcaaagacccauccccaugauucaguuaccucucaccgggucccucccaugacgugggaauuaugggagcuauaauucaagaugagauuuggguggggacacagccaaaccauaucagaugcaaaguuaugcauauguugaucagcucaauuuagccuuuccaucauguuuacauauuucaaaauaauguguugugcacaauauauaugugcaauuuuugucaauuaaaaauaaauuaaaaaaauuaaaaaauggcuuucccacagccugucgacuuccauccccauguguggcucuccccagggccucccuucuuguucuccccaguugcagaccucagacaggagucugcuugucuuccuaggcccuugucagaguggaagguggcccuccaccacaccagcccacuuuccaguuaucaaaaaggaucuuugauuuaauauuuccagagcaauuuuggugauuuccauucaaaucuguuuuuugucauaacuaccuugcuugccuaugggacauguucccauuucagugcauacuugaccuuuaccauaaaucacauauuuguaaacuguacccuccugcuguuuuauuaggcauggagaagcagucuuuucuuuuucuugauggccuggguugaccagauccugacuuuuguggagacauuaaagugcuagaaaugauaauggugaaagauucagaaguugaaggagauauaaggagagaaauggacaauucuuuugguaauugaaugaaauaagacucuuaggaaaauucuccccaguggcaauguuguaagaaacaccaggccgggcacaguggcucacaccuguaaucccaacacuuugggaagcugagacaggcagaucacuugaagucaggaguuugagaccagccuggccaacaugguuaaaccccaucucuacuaaaaguacaaaaauuagccagacgugauggugcguaccuguaaucucagcuacucaggaggcugaggcaggagaaucacuugaacccgggaagcggagguugcagggagcugagaucacgcugaugcauuccagccugggugacagagcaggacuccaucucaaaaagaaaaacucaacgaaacaccccagcuucuaucauucucaagcuuagugugugcaagacucauggaugcugcuuguuauaaaggaagauaaauuaugaacaggcagacuggucugugaaccuuacccagaaaaauacacaguaguccaguauauuggccuccagggcaaagcuaccuagguucugaguccaauuauggccuucaugagucuuguuucuuuggacagguuuuccagugucucugagccucaacuuccucauguauaaaguggagaugaugccauuacagguugcugcuuuauggcacauaauuaauacuagcucuuauuuauaggaacugaacaaagccccaguuguuuugaagcauguccuaucauuaacacagguaaucaggauauauucauugaagucucacugugugccaggcacuaugcuaugcaccuuauguguguuauuuuauuucauccuuccagcucugggaggugaugacugucaucugcauuuugcacaugacaaaucugagggucagagaacuugcccagggucacacaauuaguagauggcagcucaagggguuuuugccugcgucuucacccaaagccacuaacacgggaucugucaauugcauugcuggugaucaagaaaugccagcuccuccgcucuucccugagugccuuguuggagacaaaaccagcaggguuauauccccagcacuguaauuuaguguggcagucaggggaaaacaccuuguagaauuucauuucuuaucauuuaauguccccuuuaauucucauuuaaguuccccucuguaaaaggcagucccuucagcucucauaaaacuuuauggucuuuacuugugauuaggcaaugguaaaauugauucucuaaaaccaacuucuagucaaguuauguaauuagccaauaagggaggcugagagaggaagauauacaagguucucccucaagaggucagacguauuaucauugguuagaugccguaucuuuaaaacaccaucagcuuggaaaacacuauccauuagcaagagaucagagcaagagaaaccucgaagggucgaacgguccauucugagggcuccacaaagaacucggcaucccagaaggaugauuagccuuccaucucucgaguugucucagagcacaacaggucugaguguuuuuuucuuuaaugaauuaacccuuuggauuucagcccuagcuuuugcuucccacaucugacauccugcccuaccuccugccagaaaagauuuugauuucgaucauggcaguugcugucgcugagguaauaugaggagauccgagaccucauccuugcagggagugggcuugagauaauucucguuacaaguuugccuagugcuucacauaagcagaggccccaagacaucagcaagcccguuuuuugccucuuccugguucaugguuagacugcauuuuugagccucugccuguuaggugcagccaugugccugagucuuggccaauggacuguuggaagacgagacguuggccccuucucaaccugaccuguaaaaaccugucuugcaaaacccucacggcucuuuccccugcagucuugaugugaacaagcaugaugauguuggaagccauacacaagcuggauagagccagggucccugaguucaccacccagagcaaagucacuugucgaucagaaauacagaacuaguuuuggacuugaugugagaaaucuuuuacuguaucauaguagcaagcauuaccccaaccaauaccugugcucauacugcuacaguuuuuuuuuuuucuuuuuagugacugggucuugcuauguugcccagacuugggugcaauggugccaucauagcucacugcagccuccaacuccuaggcugaagccauccucccaccguagccuccugaauagcugggacuaaagugugcaccacaaugcccagcuaacuuuuguauuuuuuguagauacggggucuugcuauguuguccaggcuggucucaaaguccuggccucaagugauccuccugccuuggccucccaaagugcuuggauuauagacaugauccacugcacguggcccauacugcuauuccagacaagaaauuguaccaggaaauucacugauauuauugguccaucugaggaucaucagagaugaaaaugagauuugacaacugcauuuggaaauggaguaugacaguaucauucugauguagggaggauaucaccucacaggagucuuuccuggcuauccuguccaaagucacuacucacaauuucucuaucccauaacucuauuuuauuucucugucuagcacuuaucacuaucugauauuuucugucuauccauccgucuauucauucauucauugcuaauuuauuaguauugccuucccaugaacuauuagcugccagagagcagggaccucaucuguccuguccacucaugucuucagcacuuagaacaguaccuggcauauaggaugagcuucagaaauauuugcaggugagugaaugagggagugaaugaaugagggauuugcagcuugaacgcuguacuuugaaacaguuccagauucaugaaauuucuuuuuaaugcagaagauuucuuaugugauuaacugaaugggaauugaugcuuuguggaaugaaauggauugaguacagagugugggaucaagaacuuuuaggcacugugaguauaagagggaaaccaggccgggagcagcggcucacaccuguaaucccagcacuuugggaggcggaggcgggcagaucacgaggucaggagauccagacuauccuggcuaacacggugaaaccccgucucuacuaaaaauacaaaaaauuaacugggcaugcuggcaggcgccuguagucccagcuacucuggaggcugaggcaggagaauggcgugaacccaggaggcggagcuugcagugagccaggaucgcgccacugcacucccgcccgggugacagagcgagacuccgccucagaaaaaaaaaaaaaaaaaaaaaaaggaaccagauggcccugcccuugagcaggcuguggucuggccugguggagagacagagaaucaguuaauuccagggucauguauuaggugguaagauagugguucacaccaaaaacauagaaaaugaucacuuagccugauccacaaguucaggaaagggcucugagcaggagauggaagaccucuuggcugguuaaauggagaucaaguggcagcuuggacuccugcugcaauuaaaaaauuacucuccaguuuucuucaugugccuccccauucacuccaccaccacucaccccaaaucagaucaugauucauuuggguuguaccgauuaagaggguucccuuuacaugaccauuccagucaugaaacagagaaucuggucaccuguccuuuaucuuggcugguccaauuccauaagaaguaaaugcugugugucugcgauucaaaagaccccuuucacgggaggcugggagauuuuuccaucuaaauagcuuaauuguuacucuacagggcaaucauaaauguaaaucgacuuaauaugacuugauuguuaguaaugacugucccucuaaugacgcuggccaaugagccuacacagaaugucgcaugcagaucaaugagccaaauguuagcaggggacugggcauuugaagauuuaaaaaaaugaaaaauugcacugugacauugcugguuccuauuagcaaaauaacagacaguguuaucagucauugacucagaagauaguuucuuaccguuuggggaaagugcuugucuauuccucuccaaagccauuuaaaaaaaaaauugcaccaguucucaucccgucaucugccuugaucaaacauuugcuuauuggaaucacuucgaaaaggaacuugguaucguucacauguguuuauaacucucaaaucuucuucuuccaauuuuuaaucuugaucaccacagcuuuauaacaggaagaacgcucaaagaagaaaaauagaagaagccugaauuuuaauuugcuauuucuucacacacaaaacaccccaagcucaaucaaugcccagaaaugaaggccaauagaugauaguggggccucagauuucccaccuauuguuuugaacucuaauuagggaaagggaauuuggaaccauugucuucucugagugugcagacacgaugcuaucauuguguuuacagagguggucagauucccagcacaguguacucccgcacagauaaccgucccaucuugauaaaacaaugcucucagccgaauccuaaacacgcugcacaaggaagaccuuaugcugacaguagggaggaagcgacauguuaacaaacaaguuugccggccaggaaguuuuaaucagcgcuuucuacugcaggggguaugauggauggagacccuguuucagagggguuuccuuuagauaaaacaauaauaccaugcuuucaagaagcucguucgacagcuguaaagcuaugauuaaucccccaaaagucaaacaugggaagacuggcaagaugagauuauucacuggguauaauuagccacaauuaucgcuaaagagaauuuggggagauucugcucuaaagggaaaagcuuuguaaaggagaauuaccaguagagugaccuuauaauuuaccauccaauggauuuugaauacuucugagagagaaaugagauacugauaauaauuauaccaagacaacagacauaaauugggauuggccuagacgagcaaagaugaauggucauucugucuguuaguaaaauuccaucccaggcacaauaucucagacuugaaacaaaauaaaagugauucuuucuaggauaaacucuaaacuaagugucugauaaauucugggaaaguuuauccaauuguuacaacccagggucaggaaaacuguuuucaauuuucugcuguaugaaguugccaguguuaaacccuuucgauagcaaguagaagaaauguucauucaaacaggcuuaauuaacugaaagauauaggugugguaaggggaucagguaaagcuugacccaggggcuaaacuuuaaggaccugguuccccucuuuucaucccuugguuuuauuuuucucagcauuggcaccauuuugugacaagcucacuccuugggucuuaugacaaauguugacucuucuaaaccacaucuuuccagauucaauauaguaggagaagaccagacuugcucuuuuccuggaauuuagucugacguggcugggacaacaugcccacucucaaccaauuuuuguagccauggagauuuggaagucuggcaagucuugggucacaugaucuaccuuacagcuguuacugcagaccucccaaagcucacgaacugagagucaggaggcgugguuccccuaacucaaaucagaauuucguuaucaaaagaagagagggaugguucuguggugucccacacucaaauaaacauccuuuaaauaccucuagaugcuuauaauuccuguugcagccuuagucagugggagccacugaccugcauucguguaggaacugagcaagguucaucuagucucgguagcuaccuaccccgagagcuggcugauuuuuuuuuccuuaaauuuaauucaagacuucaugaagucaacaaaauggucuguuggaaauuauuccuaacccccaaccacugucacugccacaaucaaacauauuuucauucuuuugcagcugcagcccuucuacuugaacuuucccacucauugcccuuauaacuugccauuuaauaucucuugcuuuccuacauggcugugacuacucgugggcagggacuguaucuccuguuuuugguagugccuccagaaccaaacaccauaugucauaaggucuauuaauaaauaucugcuaguuuuuaaaguuugagaaaaacccguauuguggaaugaaaaugauacugacaaggaauacaucuagaucagaaauacugauauccuaagugagaucuuguuuuuuaaaacaaaaaaaaguuuaagaaauugucauauaggcugggcgugguggcucacacacauaaucuuagcacuuugggaaguugaggcaggagggccacuugaggccaggaguuugaaaccagacugggcaacacagugagaccccaccucuacaaaauauuuuaaaauuagccaggcgugguggugcaugcuuguagucccagcuacucaggaggcugaggugggaggauaggaggcugaggugggaggaucacuugagcccaggagguugaggcugcagugagcugugauugcaccagccugggugacaaagugagaccuugucucaaagauaaaagaaagaaagaaagcccuaucaaaauuuuaaaaaauaaaacauaagaaaaaaauaaauggauacaugauauuuguacuucuaagaggcaucuucuauacauuuccuguuucucucuuccuuuuccuaaggaguccuuguugauuuguggccaugaaaccucucuccuuuccaggcuggcuucuuaccuaggucguguccuaucccuuuauuuucuggcagggcuggacugucacuugguuguucucgguuucaggacccacgucuuuugucucuguaaugaauguguucagaggucucugcacagagaagcuggcuguuaagaaaacuuuuucuucuuuccgagacaggcugcaaaaugcuuguuacuauuuuguguauuccuggcaggauuuguauucuuaguuuuauuacuaaugauaauaacaguuaauguugaaaucagcuccauccugaaagcacugcauccauuaucuuauucuagucucaggcccuggaggaauuuucucucacuauacccauuucagaaauuccagaauuaaugcucggaggagucaaguuacuugucuaagcucuauauuacagaacuuaaauuggcuucucucuuuccuuugcggggucucacaugauccgucguuccaaauaugagcacuuucucuugucuuuucugagcuaccuauuccaagaacacagaggaguuguuauugugguuacuugugguaagaagaguaccuuucugauuggacccagggcagaaaaaagaacuuucagguggaaauacagucguggugucagguaguguguaacuucguuaaguucagucauagcagccgcugccaaggggggcuguuccuguuccucauuuccaauugaaauuaauaacucacuugagauccuacuaaacaacacacggaacaaugaccgcaauaaccaacauacuuugaguaacuauuacaugcaugggcucugugcuauucucuuauguguauucauuuauuuaauucccuuaacaguucuuucuggcagagacacccccccacucuuagcccacuuuuauagauggcuaagcagaggcucagagaagucagacaacucacccaggaucaagcagagggcaagugguagauucuagaauuugcauccaggcaguugagucuagaauugucuuuguguauuuugcuccauggucuagcacaggaucaccauugguagaucaucacuuagaaugccaucacuaccuucuaacagcaaucaguccccuuaaguggcuuucuucucuuuuuuuucuuuuaucuuuuuguuuuguuuuuuuuuuuuuugagggagucuugcucugucugccagauggagcacaauggcgcgaucucagcucacuacaaccuccgccucccgggaucaagcgauucuccugccucaugcucccgaauagcugggauuacaggcacacaccaccacaccuggcuaauuuuuguauuuuuaggagagagggguuuuaccauauuggcccagcuggucucgaacucgugaccucaugauccacucgccuuggccucccagagugcugggauuacaggcaugagccacugcaccugacuaaguggcuuuauuuucuuauguggggauccuggagacacagugugugccaaagcgucugcagaccagucuguacaguugauuauagauauauuaaugaccacuucugagcuaaaaaaugaucuagaauaauagacuaccaaacacguaagcuuauuuacgguuugccuccuucucaugcuuuuggaagggaagcacugagggucauuguaucagucagcguagacuagguuugccgcaguaacaaacgaccccaccaugccauagcuugcaaaaacaaagacugaguucuugucuacacuguagggccgucaagagcuggcucugcuugcucuuggucuucuccaugccaggauccagaguaaaagcacagcuucucucuaggacuccaggggaaagagaaaagacaaguucuuaaaguuucuuccaggacgugacaccugacauuucacuggccaaacacagugaccuggucacucuggggcagggauguguaaucuccccauagcuggagaaguaaauaauaaugcacaauaacauugucucccaugggugcagaugugaugcuuuccuccuugugacuguuuucugucuugcugucccaaguccuaaggucccagccaccuaugguucuuuggaccugugauuuucgcugaccccgaaugacuggaggaacugcugccugcauccccaacccagcccuccuugucagucacguagaaagcaguuauuguuuccaaguucccugcccuuguuaaaugucagcuuugagugaaaauguuccuaauuuuacucagagugcaaagaacauccaggucagguaccugaccugcuugauucaugucuuggaaacacuccuuugucuuucagagaaaguaaagagugauggagacagagagagaaagugugaccuacuuuuuauuaucagcaccauuucaucugcaaaacacgacuuuucucuucuuauuacgcugagcaugaaaauaaaauguuuuccaaaagaccuggcuuuggcuguugugaggaaggccagggacuuguucaaaacucugaugagcucgaugagcaaaugauuccaauuuuuaaaaacuguaauugacuuucaaacugcucucacuguccacacauaauaugugguacuuuucugcaaauaccagcagcaagguaggacaaaaccagcucccacacuggcuguuugcuugauauuaagcuuugccaguccaauauaggucacauuuccaaccagauuuugugcuuaucucuacauuacaccuuguagcaagggggaaaaaaagagcuucuugacaucuuuuugaagaauggcgcucuuuaaaaaaacauaagggaacuuuuuuuuucaaacacuguaaugaggguauucaagucugcaggcaaaacagagcuguuugaaaagacauuagccucgaaaccgcacugugccagaauagauacagcuacgucaaaaugccgcauuuauuuugccauuacuuuucacugacuaaaaccauuugcuaaugaaaguucuagcugacauaauuucagcaccugcugauggaaagguggacucacuggucauggggaguacaguaaaauuaggagaguagauagaauccugaagcauuugagcugcaaaaucauaguaacaacagcucuuaauauccuauaauugaaaaagagauugccauuuucaaagaccuuucacagucauucucuuaaucaagucucauaauaaagaugucauugggacugagcagcuuacucacauucucauuucacugaugaggaaacuggagcucagggagguuacauggauucuggaugaccuacaggucauggagguaagagaggaauggguuccuggcaacuccuucugaguacuaacuguuaaaguaagcagagugugugucuaaacuucucaugggcuacugugaggaguaagggguaacugcaaguuagaaggcaugaugcccaagauuguccuuacucugacacccacugcaaguuugaggugguccucaaacccauccucauggcugauauuugcuagaaggacuuguggcacuuagcagaagcuauuguauuuacaguuacaguuuauuacagggaaaggauacagguuaaaauuagaucggggaagagacaaauggggcaaaguccaagacaaguaccagaugugaagcuucuauuguccucuacccaugacaucaggacagaauacuuuucuacuaucuauguguggcaguaugcauggaauauugucagacagagaaacucaccugagccucuguguucagaguauuuauugggucuucguugcguaggugugauugggugauugcccacauauuugaucucagccuccaagucaacugauaacugugguacagugucccuacccuaagcaauauuguugguccuuuaagaaugguucaucugcaaccuaagguuacauggguguaguuaggccccauccuaaaucacauuaagagucuccagaguaugaucagaggugcccaagcaaacaaagacucuuuuuuucaggaauauauucugcauauauuucagugauuuuuuuuuuuuuuuugagacagucucucauucugucgcucaggcuggagugcaguggcgugaccuuggcucacugcaauuucuaccucccggguucaagcgauucucgugccucagccuccugagucacugggauuacaggcaugcacaacaacacccagcuaauuuuuguauuuuuaguagagacaggguuucaccauguugcccaggcugcucucgagcuccugaccuuaggugauccccucaccuuggccucccaaagugcugggauuacaggcgugagccacgaccaccagccucagugaauguuuuuuaauuuggaaaggauuuuauaagaaaggauuccaacuuucccauuuacagagaaggaagcugaggcucacagguuucacucaaaccauaaagcucaggaguaacuaaaggaacuggagcuugggggucccaguccugggcaccauugcuaaguaauguggccuauuuucaauaagggcuuauuaaucauacuaaaaauaagaacuuaaaacuaaauuuuuauuugccuagaaaucuaacaucuuuagauaaaaauauuccauauucaggaggcauaauucuuucucuuuucuuuuuuuuuuuuuugagacagaguuuugcucuuauugcccaggcuggagugcaauggcgcaauguugguccaccucaaccucugccucuuggguucaagugauucuccugccucagccuugcgaguagcugggauuacagggaugugccaccaugccaggcuaauuuuguauuuuuaguagagacgggguuucuccauguuggucaggcuggucucaaacucccaaccucaggugaucugcguaacucggccucccaaagcacugggauuacaggcuugagccacugugcccggccaucuuucuuuuucuuccucuccuucuaccuugcccaccauggcuuaauuucaccagaauaucaucauuaucaacaucauuauuucuaguucagaucauucuaaaaauagagcagucauuuucuucuauauaagucccagguccagccugcuauuuuuugagccuaccuuuccuaauaucuaguuuauauuuuguuuuguucuuucuugggauugggagucagaauaucaacuuuuucagaaaagagcuuuggaaauucuacauacauaauauauauaaauuuuccauucauaguguguuagcagcuuuuucuacaaaucucuuggcggguggggggauauuucacucuucuaugaaucaaauaauauauggcuuuuuccuauuggaaaaaauuagucgugugaacuuuauucuucaagaaaaaguaguuuuuaucugccuuggaaaugucaaaaggauucacaaguuucacaagugaugaucuggguugauugcuaggaacuguuuuuaguuaguuuuuuuuuuuuuuuuuuuuuuucagacggagucuugcucuguugcccaggcuggagugcaguggcgcgaucucgguucacugcaaccuccgccuccuggguucaugccauucuccugccucagccucccgagcagcugggaguacaggugcccgccaccacgccuggcuaauuuuuuguuuuauuuuguuuuguuuuuuuuaguagagacgggguuucaccguguuagccaaggaugguuuugauauccugauuucgugauuccacccaccuuggccucccaaagugcugggauuacagacaugagccgcugugcccggcugcuaggaacuauuaauccauagacaaggcucugguuagagaagcagaaagaaggcuggguagaccggggaagguagcugggaggucucugaagcuuggucuugaagcugugaauucauagacgucuuggaaaagaacuuuauaaugugguuagacaaguuuuauaagauuuuaggauuaggaaggcuuuuuuagggggugggguugcuuuuaaacuuuguuugaaaaauggagcuugcugccaucauaucaucaucaaaaauggaacuugucuauccacaaauauuuauuuaaaagucagacuaauggcagaauggaaagaaucccagcuuuggaguuaaaauaucucacuuaaaacuugucuucgcugcaggcuacuugguuguacuugaguaauuuacucaagauucucuucagcccaguuuccuuaucuguaaaauccuuccacuguuguuaggaggauaagaaagccaguauugguaaaaacauauaucagaguccuuuugacuguuuagaaaguguuaauuuacuccacgauuauccauucaacauuuauuaguuggcuucugugugggagaguaaccauuaauaccuugaauaaguuuauaaucuggucauucuguagagcuuccuauaugaugucuucuguuuaaguauuucuguaauaccuuauagacaucucuuuuagacuacuagugauuguuggugucaacauaugugugaaaaugcauauauccuuuauuaggcucuagcacacagugugcucucaauguuugucuuuucaaauaaacauacuuggccaggccuggagguucaugcuuguaauuccagcacuuuggggggccaaggcgggaggaucaguugagcucaggcguucaagaccagccugggcaacauggcaaaacccugucucuacaaaaaauaaaaaaguuagccaggcaugguggugugugccuguagucccaguuacuggggaggcugagaugggaugauugguugagccugggaggucgaggcugcagugagcaaugauauugccacugcacuccagacugcaugagaacguaaaacccugacuuaaaacaaaaacaaaaagaaaacgugcucauuggcuaagccugguagaagccacaugaccaaggcugaucauugcugccacuggguggcagcauacugggauugaggaaaauaaccccucaacugcccggaugauaaacacagaguucuaaaauggcaacaaagggagauccacccuucucaguuauuguuugaaaggacagcucucaggcaaaauauguccacgaaguuccauggaauaauuaccuuccuugguguuaaaaaaugcccucacauuucaaacauguccugcuuuaaguucccagcgucuuaaccaggaacucgcuuauguguguuguuuucugcuucuuuccacuagggagcuauugcuguaaaacagaagggguaguauuacagggaggagaugcacauuuuaaaauauauuucugcuucgucaaacuguacagaacucuuuuccucaaugagaaccagguuuuugcauguaucuuuugccaagauuugagaagggaagucuccaccuuccagagcuuuggucauauuuuguuucucucuaagggugaagaugcuguuuguucuugcagggugaggcuuuggccaauaagaaagcagugcucagagguaaagagccucgcugaagcccuaguucuagccuaccaggauuuggucauuucuugguuuuucauuugaucccacccuugccucccuucagaaugaagguagaaugugggacuguuucagaccaugaaugcgauugggcagaaagacugugaaccaagagggcagggagaagggaagggauguggggagagcuaaguguaaauuguagagucuaugaacaauucuggagacagacaggacagguaaggagaaacugcugcucuugguagagguuuacagccaauuguagaacccuaagaaaauacagcacuuugggaguggauggacccaaaauggguggaucauuugagcccaggaguuugagaccagccuggguaacauggcaaaaccuuaccucucaaaaauuuacaagcuuagccaggcaugguggugcccacuugugguuucagcuaccugggaggcuaaagugggaggauauccugagcccaggagguggagauugcagugagccaugcucgugccauugcauuucagcgugggugacagugagacccuaucucaaaaaaaaaaaaaaaaaguuccuaagaaaauaaagccuggcccaugcaauuugaauguaacugucuauaauuucucuugguuacugaaauucugaguuugugucuaugguuucuccauccuugucuuugaggaggagcaggauggcgaagucgcagccauuuaaaaacuuguuuucagucauuuugcagaaagcagacguacacuucuuugcuguuggucugugaugcgggagugguuugucaguucuuucauucaacaagugcugaucuuugggcagcauacacugguaugaccuuuaucauuuguucagguguuguggagaaaguuguuugcuuuugaaagacuugauggagaaaagucuuucuacauuucuagaaagaccaugggugugaguauugagagcugagugccaguuuguuuuuuuguuuuuguuuucguuuuuugagaaggggucucacucugucacccaggcuggaguacauuggugcgaugaaggcuuacugcagccucuacuuccugggcucaagugauccucccaccucagcuuccuaaguagcugggagcacaggcaccagcaaugacaccugccuaauuuuguauuuucuguagagaugggguuuuggcauguuucccaggcugguuuuaaacucuugagcucaagccauccacccgccuuggccucccaaauugcuggaauuauaggcaugagccaccaugcccugcccaggcaccauucuugacugcgagaaagucacugugaugguuucuccagccugaguuuucuccuguauaaaauggaccuuguuuugaggagagaaugagguaugugguacucgugagcaggauuuucaaugccuggcugguuguuacuuauccauuuaguccgagcuucagggaaagaacaugacaccggccuccagcagagccugcucuugguccacuguuuauccuggugaccuuaggcaagucauuuaauuuccuugaguuuugguguaaguauugauggagcagaccaucaauaacuguucuuaugucuguuauuaccaugugucugucuacauguuuguuuguaaauucucuguggguaaaaguucucuuuucauccccuugccucagcacggagcccagagccagacugcagguaggcacucaauagauauuugauaaauggauguuagucauuugauuucugaaguugcguagguaccagcacuacaacccuauguaguucacauaacuauuugcaguuguauuuuccuuuaaaucuaaauuggagagaaggaagguaauuaaggcauaauuaucagacuuaaucaagcacuuauuuauugagcuuacuuggugccugggcuuguaucuuuuguuucugauuuuuaguuucguuucauugcuccagcgugggggaauuugccuguguauccuugaauaaaugucuuucuuuggaaggcagauuaaguagggauuucucuuacuguuuauuuuuguuucuaacugaaguucaaugaauuauucuuuuacccagacacuuacauauuccuagccauuccuuuugcuuaaguuugcagagauuugugcuuaaaacugaauaaacaaucucaggguuuuuguguguguguguaugugugugugcguguuauaugaagucuugcuagaaugcauaaacaaacaaaaaaaauaucauacucucagauccuggauacuguggucgccuggacuucaaaagccuuuuguccguauguauuuacauaauguauucuccauguuugguuuucauuaaacccaugaguuuaauaauaaaguguuuggaacuaugcuuuucccuaccacuuuucuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugaucugcccgccucggccucccaaagugcugggauuacaggcgugagccaccgcgcccggccccacuuuucuuguugugaauauuuuuuccccuucugaagugaauacugauuuuucguuacagauauuugaugcuuugggggccuguuaaaauaguuguaaauacacuuucuaaauagaugaaaugaaagaaauucugagaagggguuucuuugacuuacuggaaaaaaaaauaauaggaaagaaaaugugaucaguugguauauuuggcucucuuucaucaacacuuuuauggaccugcauugcuguguuucugugauguguauaaaacacaguuucagugaucgugcaagccucaguuuuagaagauaaaaagauaugaacuugaacccaagcuucucugucaagagaauuauaauguguuuugacuguaggcuuccuucgaguuaaauuuacaguauuuuccccuaacaauaacaacaaccagaagugccccuuuaaguugagaugcuuguuaaacuuuacauguaugcaugcauauaaauguacauuucuguauauauaauauacguucacauauaguuacauuagauuuuuaaagaauuuccuuuuugccuucaaaucauugcacagaacauccaaguagacaucaugucaaaauaaucaaaauguauuuaacgcucucucaagaaauccauuuaagaauaagaacacgguuugggggugauuuucagaccguaaauugaaguguaaauauucgaauuauuuucauaaacucuucaguucuguugggcuuuuauguuaucauacagugauuuuuuuuuuuguauuuaaguuuccuagcaguucucuuuuuuaagagccucaaguguccaauaaaaagcaaauacuugaauuuucaguuucuauauagugcauauuuuuucuccugcuugccuuauuuuuauaacagugauuuauaaagacauuacuaaagaauaggaaagaaggauuuugaagaggaacugcuauauaacacugcuuaaaaaucuauuuccaaugcuaaggagaggaaaaaaaaauacuggcaccguauccgagugggaucugggauccgagugagauggccauaccuucagucauucuccuccccaaauauuuauugagccugguggacaaggagggcgggauaagauugccaggcccugcuucuauuucugggguugggauggcgacuaaagacccgcguggacugcaugcugcagccagcucaggaaagauuucaggaagagcguuuaggaaggcagcuuugaaaagaaaauggaaagaugagguugcagagggucaguccaaggugaccagaaucugaccuggggcaaugccauaaauccaagaaagacuggguuucaggugcaggaaaugcgauugugcacggacccuugccuuuuuacccaguaucuagcccauccuucuuucuuagaagcagaauuuucuaagagguacacgguaguucaggauaaaaauucccugugcuaacugcccuugcagcuagcucucugugaccgugugaccaugugacccaguucuagcgaaugggguggcagggaagucccacauggacuucuugggcguguccuuaggggaagcauagcuucuugccuucuucacacuccuccuucccuuccugccgucugggauguggggucuggcagagaaacaauauugugaauggaaaugggaggaacuuggguccugaaaauuacaccauaccccagagccugggguggauuauuucaggaccuuucuuccuuccuuccuuccuuccuuccuuccuuccuuccuuccuuccuuucucucuuucuuuuuuuauuuuuuuuuucagacagggucuccuccacacccagacuggagugcaguggcacauucauggcucacugcagccucaaccuccugggcucaggcgauccucacaccuuagccuccugaguagcugggacuacaggugugcaccaccacacccagcuagcuaauuuuuuuuuuuuuuuuuuuuucuguagagacgggguuucaccauguugcccaggcuggucuugaacuccuagccucaagugauccgccagccucagccucccaaagugcugggaucacaggcauaggcugcugcaccaggcaaggacuuuuuuuuuuuuuuuuaaacaaacuucacucaguuugaaggcaccauuauuuggguuuccuguuaauugcaguuaauccuauugaguaaauguaucaaggacaaagagcagaaugaaaaaaugagugaguaaaguugagcagaagaacucacugaaaaguccuggcaagguuccacggcaccugugaugcuuccaucacacauauuugcugaguacccgcuguucauaggucagucgcuaugcaaggcacugaggugacaaagacaaggagaaugacaguuaaauguaacaugggcuuuguggucaauuaguucuggguucguucccagguccuaucacuaacuaguacccuuaugaaccuggacaugucacuagcagccucaguuuccucauccauaagauggggauagcaauaucuaucuccuacaccugaugugaguaucacaugagaaaugcacaugaaauguuuuacuuagugaugagcauaugguaaauaagaauuuaauagauuuuagugaaagcaaaauaaaagguccuaucauuguccuuaaggagcuuacgaaaacagagcuauacgcacauccguagacaguuaccacacucaggaauaguggaaaacugacaagacccuggagaugcuguguggggagggauaaugggaacgcaggucagcaugcucuaggaaugguaagagaaacucccaaucugaacgguagucaaagaaggucuucuucucuuuggagacugaaaggcugagaggguaccugcccugcuaaggaaaugaacaggacggaagaaugauggagggagaaugggaaguccucagcacauaaaaguuugagcuggaaaugaaauauacaacucugcauagucagcagauuuugcugggcugggccaguucagcucagcaaggauugcugggcaugugcuugaaggagaaaggugaggauacaaaggcaaugaguacaugauccuugaccuugagaaaccuauagucuaauagaggaggcacauauaaaaguaauuagguaaaauauagugcagaauaugcagucauggagucaucuacagaucugccuggaauacagagggacaaguguuuaguauuuuccaacuguucacagaggacaagacacuugggcagaaguuugaaggcaauuccagguuagcaguacccacuugauaugguuuagcugugucuccacccaagucucaucuugaacuuuagcucccauaauccccacgccacaugggagggauuugaaucgugggagguaauuggaucaugggggugggucuuucccaugcuguuguuaugauagugaauaagucccaugagaucugaugguuuuauaaagggcaguuccccugcacaaacucucuugccugcugccauuuaagacauguguuugcuccacauuggccuucugccgugauugugagacuuucccagccauguggaacugugaguccguuaaaccucuuuccuuuauaaauuacucagucucagguaugucuuuauuagcagcaugagaacaaacuaauacaccacuugaauugcugguacgucugaggggcuugacucccaguccuucgaacauggagggguagcucuuuuucuaagcuccucauaaaguauuguauccaauucuucagaagggaugaagguaucugguccuguccgcaaacagagaagugcuucuuguacugaccaggcagugaccuaacgcaguccuugagacaauuccaggugccccucaggccguuuuuccacccugguguuuuucuuuguauagacagccuaugccuggauaagaacaugcugcgucagagaguucuuuuucacuuugccccucaaaaugugcacaccgacagccacagauagaucccagaugucuuuuuccugcucuugcaaaccuugaagugggcccugccggcaggcacaccugccaaggaaaaugcuguccucgaaauguuccuggcaccguuuucaagaggugccgaccaagcgcuggaauugcugaccucccugaaagagaagccugcagcugcggccucuggggugaauuccccccaugggaggaccugguggaguuaaaacagacuauauccacaucacagagagcuggcccauugcucagggccugggaagugguagggagggaccuucccagaagagagaugacucaggcuggucccaagccccuccuguagaacaaacagacaaggugaggagcaaggaggcauuuggaggucaucuggcccagcacccuugucuggaagacagauuuaaguuccauaaagucacuuaggaggagaacauaguccagguugaaccuugcugccugcccucugguugaaacaucaguguugaaucaauagaccacguccuguccauaccuugggaauuagacucacccagacucugaguuaagaguuucuaugagacagagggcuggacugggggagcaaggcuugcaaaucgaaagcaucaguugcuaccccugagcaccaucucccauaggagacucuuugaacacuuuuuuaaaaggcaagauguuggccuggcgugguggcucacgccuguaaucccagcacuuuggcaggccaaggcggguggaucaccuaaggucaggaguucgagaccagccugaccaacuuggcaaaacccagugucuacuaaaaauacaaaaauuagcugagcauggugucacaugcauguagucccagcuacucaggaggcugaggcaggagaacugcucgaacccaggaggcugagguuauguugagccaagauugugccacuguacucuggccugggcaacagagggagacuccgucucaagaaacaaacaaacaaaaaaagucaagauguugacauaacaguucugaagaccaaggugguggaauagguuagguuaggauacgucggaggagccagugugaacugcuccuuuaagacaugaauuagcccauuuucaugcugcugauaaagacauacccgagacugggcaauuuacaaaagaaagaaguuuauuggacuuacaguuccauguggcuggggaggccucacaauuacgggggcagacaagagaggagagcuuguguagggaaacuccuguuuuuuaaaacuaucugaucucgugagacuuauucacuaucacgagaacagcaugggaaaauccugcacccguaauucaauuaccucccaccagcuuccucccacgacauuugggaauugugggaguuacaaguugcaauucaacaugagauuuggguggggacacagcuaaaccauaucaaaacauaacuauagcugggugaaguggcucgcaccuguaaucccagugcuuugggaggccaaggugggagaauuacuugaggccaggaguuuggggcuagccgaggcaacacauagagacaccgucucucaaaaaaauuuaaagaaacuuagccggggccgggcacgguggcucaugcugguaaucccagcacuuucggaggccuaggugggcagaucacaaggucaggagauggagaccauccuggcuaacguggugaaaccccgucucuacuaaaaauagaaaaagaaauuagccugacaugguggcacaucccuguaaucccagcuacucgggaggcugaggcaggagaauggcgugaacccaggaggcggaucuugcagugagccgagaucgcaccacugcacucuagccugggcgacagagcaagucuccgucucaaaaaaaaaaaaaagaagaaacuuagccaggugugguggugcauaccuguaguccuagcuacuuggaaggcuaaagcaggaggaucacuugaguccaggaggucaaggcugcagugaacugugaucacgccacugcacugcagccugggcaacagugcgaaacccuguaucaaaaaaaaaaaaaaaaaaaaaaagaaacacaacuuaccaaaccaagaaacuuacagagaacaugauuagaagcuagcaucuguuuuuacccuacccucuuccccuaugacccaccaccacgcaggccuugcuaauguggggucuuuguggaggaucuucaggaucuucagugccagaacccagcauuuaaacucuuauuugacaguggggccacagcagauuuaaaaggacaaugacaugauaaaaaauguguuccugagagauuuaaaugcaggccuauagagagcagauguuaaaagagaagaagcagacugggcaugguggcucgcaucuauaaucgcagcacuuugggaggccaaggcgggugcaucacuugagcccaggaguuugagaccagccugagcaacauggugaaaccccaucucuacaaagaauacaaacauuagacacuuuucaaaagaagacauuuaugcagccaacagacacaugaaaaaaugcucaucaucacuggcccucagagacaugcaaaucaaaaccacaaugagauaccaucucacaccaguuagaauggugaucauuaaaaagucaggaaaaaacagguccuggagaggauguagagaaauaggaacacuuuuacacuguuggugggacuguaaaccaguucaaccauuguggaagacauuguggcgauuccucaaggaucuagaacuagaaauaccauuugacccagccaucccauuacuggguauauacccaaaggauuauauaucaugcugcuauaaagacacaugcacauguauguuuauugcggcacuauucacaauagcaaagacuuggaaccaacucagauguucaucaaugauagacuggauuaagaaaauguggcacauauacaccauggaauacuacacagccauaaaaaaaggaugaguucaugucucuuguagggacauggaugaagcuggaaaccaucauucucagcaaacuaucacaaggacaaaaaaaccaaacacugcauguucucacuaauaggugggaauugaacaaugagaacacuuggacacaggaaggggaacaucacacaccggggccugucgugggcuggggggaggggagaaggauagcauuaggagauauaucuaauguaaaugacgaguuaaugggugcagcacaccgacauggcacauguauacuuauguaacaaagcugcacauugugcacauguacccuagaacuuaaaguauaaaaaaaaaaauuagcugggcgugauggcaccugccuguaccccagcuacuugggaggcugaagugggaggaucacuucagcucaggugguagaggcugcagugagcucacaucacaccacugcacuucggccugggugacagagugagacccugucucaaaauaaaauaaaauaaaauaagcagcagcagcagcagcuagguuccaaaaaaaaaguuggaagggugugaugggauuuuaguugcuggaugcugaaguucugccaacacaguggguuuggagaguaggagugaaagaguggagacuggccauaaguugggaggguaaguaauugguugugauugaaaggaaagaaggagguaaugaugaguuuuggucugggaaccggagaauggugguccauggacagaaauagagaaggcaagaugagaagaugcaauaggcaaaggcagugaguuuaaugguugacuuuugguauuugcuguguaugcccucuguaccuuugaccugggccuucaacccuuggacagagcuuaagauggcugcgucccaagugguccaucccaagcgaguuuucccuggacuuaucuggaaugacucugaaccuuuugaagaccccaaaacuaacccaagcuuugcaugaucuccccaggauggguaagacuucuuacucucuagagcucuuuucucuguaggcuuagcuacucagugaauaaauagguacauaagugcuugcuagcaagcagcugaggcaaccuauuaaaacucaugccagugguaaaguuaagcugcuuucugguaagaauuucagaauuccaggacgucucaaauuucuggcugguacacccugggcaagguccacaggcuggauggguuuuggaacaugucuugauuguacuuuuuccucuugguuuggaaagcaacguacccuagguaaggagagauuucugacaacagcucagcaaucacaguuuccagaaaauggcuccaguggaucaacuaugaguuaaguaaaaaaaaagucagugcuaccguuugaaguaugucuagaguaugguuuuaauccaucgcugucaggcucacauaaaauuccaggcuucuguaacucuuuaacuugaaguauuacagggugucaccugcuaaauggaagccaagagaagcaaggaguuuuucaugguuaaaucuuguaaagaugcuuuuuaaagcauauuaauccauuaguaauccauuuggauuugggaauacggucauauacuguuugguacaauauguacuaaaccugguccuggaaaauuaaguggaaauauagguuuaaacuacuggaacuucaaaauagcuucucaguaauuccuucucagcaaucauuccaauuccuagauuuaaaaaaauguugauauaucaaauuuccaucaagaggaacauacauauggauuuuuggagaggggagcagagcagaagagaaaacuuucaacuuuuaauaguauuucaaauuuaccugaaagugacccaaauaauacaagcaacuguuuacccugauucuccaauacaccugcaucuuuaauuaugcuaauuugauacaggugucagauuaugcauuaacaaagacauccuuuuucuuugaguauguguuuucuaugguuauguaaauuauggaggugcuaaacauaccuuuagagaacuuuguauuuguauuaacuuuuuuuuuuuuuuuuuuuuuuuuuuaauagcgaugggguuucacuguguugcccaggcuggucucaaacuccugaguucaagugaucugccuugcuuggcuucccaaagugcugcgauuacaggcaucugccaccgugcccagcuauagagcuuuauuuauuuauuuauuuauuuauuuauuuauuuauuuaugagacaaggucucacucugucucccaggcuggaguguaguggcaugaccucggcuuacugcaaccuccgccuccuggguugaagcgauucuccugccucagccuccugaguagcugggacuacaggcacaugccaccaugccuggcuaacuuuuguuucuuuuuaaauagaggucuguuuuuacuauguuggccaggcuggucuggaacuccugaggucaagcaaucuaccugcuucucucucccaaaguguugggauuacaggugugugccaccauguguggcuauagaacuuuuuaaugugccaaggucuguguucaguguuuucuuauuccucaucugacuuaguucucaaaguccuugccuaagguauugcuguccucaccguccuauggggagauaggucacuuucccaagucugggcagccagcagcagggcuaagaucaccacucagacccugugauuuuauuuuucaucuccucacaucuggcgcugaaugucaggaccuuccuggccucugggaaagacacaggauggcuguuuugagaggagugugaaauacaugaaggcaggacuuccacacaccuggacgugaacuagaggugagguggggaaagacaggaaguagaucaguguugcccagacccuaccuuuuccaacuaggguguggaccauccuucagagcuuggccuccaaguuggaacccguguauaccacugacaguguuuccugggauggugauauuuaucaagugcagaggcccagacacagagagcuugaggaccuuugugugagacagugaaacccucaaaggcaagggcucuguuucaugaguuuucuaucuccugcugcugucucggugggccuguuugaguugaccugucccgucgguauuagcaacuggcaacaguggguuuuuguuaaauacggcaaauauuaagagucgucucugggcauuuuaguuuauucauucauuuguucauuuauuccacagggauuuauuaugcauuuacuguguacuaacuaauggggagauagcaaugaaggcagacuaagugucuuuguucuagugcagccauauagucagugaaugaaugagugagcaagauacaggagagaagugagguauggcccauuauaccagauaaagugauagagaggggcuggcgaggagagcagucuaauuucaggaaagucagaaaagucuuuaaggaaacugaaggcugagcugccagggccagccacguggguacuggagagugggaggcccagucagggggaaugcuggcuuagcacaacugaaaaauacaaagguagaauaugaaguguaaugacaugguuuagauugaaaucugauguggauggaaagguuuuguggccuuucagcccaagguuugaaaaagaaauggaauuucuaaauggaguggguagccacaggagggcuuuagacaggacaguggccccgcuggauuuucugcccauugacuugggcucgaagucacguccauguugcuauuacagaugccucccagaacaguuuauauaaucaucaacguauauucauggagcaucuucugucugcuagacacagaauuggguguugggcuuuaaagauggaugaaaggcaguaccuggucuagagaggcugcuaccuggaugguguguuugccauccucaguaaugugugucccuuacagaugaugcccaaugacucuacaauugcugggauacuuuuuagaauuuucuuuuugugcauuacuuuugauucuugguucuuucuuuggcauuagcucaccaguggcaaauauguauccuuuaaggguggacuuaauuuuuugagaaauggccaaaaguuuguuucaagucuagucugaugaauaaagcaggagauuuauuuuuggcaaaaguggcaaauaaagagggcugauuuuuguauauggcuacugaaauggcuuagaaugccauuuuaucacauggucaaauuauucaaugaucaaauaucgaauuauuaaaaauuaucaaaaggaaguucccugaaacaugaaaguguuugggcuuuguagguacccaagucuacugggaaaaauccccauuucuggguaacccagccccuuuuaaugacaacuucaguucuccaaauuccacuuccccuuuuagccugccucccuuccgucauccuucaucaaggugacauaggucuggcgaucuuuuuggcauagacguguggacguuguuuuugacauuuguacaugcuuuugcucaaguugaaggcccaaguuuacccaauucgacugcccccacccagauagaauauucaugguuagaccauaaacuacauaacuggaaauuuuaaaucuauuuuuauaugcauacaaaaacugcaggccugaagcuucuaaaaauaaacguuacuuucaucccauuauacaaaaaugcauuugagguggucaucauuuuauuugggccagggucuuccgagacuugggacaauaauauauuuuuucuacuuuaggcaaauguaugcagauucuuaaagcaugaaugcuguauuacacacauuauaaauucgaguaacagaaauguuuguguguagaaauagaauacggaguauauauuuuguauuaaauaaccucugugguauuuguuuacccugauuuuuugauuuaugagucgucauugcucgcuauagaagaagaaaaauaaauaugcaaaacagugguagauuuuuaaugggguuacuucccaucuuagcucaguguuucucuaccaaagcugaccuugaaauugcuuuuuagauacaagucaaaauaugcaaauuccagaaucaggaggaguauccgguguuaggaguucuuucgaagucacauuuuuacaucauuuccaucgacaucccguguuccaucugcuucuuaauccauuaguaccugaguggggguauauagguuuucucaaaugcucuaaucuccacagaaguuaaaauaucccuaaacaggcaugugcacauaugucuuucuuucuuuucuuagguuaacuuuuuuuuuuuuuuuccuuuugaaugaccacaaagcauaucuacccagcgggguuacuuuuuuuuucccuuucaguauucaugacgucaagucccuguuuguuaucuuauuguccucuuauccugguccuuagagucuuucaagagaagagguugaucccgguguaauguacagcuucauucuaauaaguuguaucgaucauguauuuucagucacucuucaugucuaugcuguccauuugcuuggaucccaaggaauuuucuucugcccccccaccccaucccacucauauuucauaagggucuucuggaaccugcaugguguugggauguauauaucacuuuucccuuguuaugaccagaaagacucacagccaugaauuucacugaaguuuaugauuggucccugauugccucacaucuugcaaagaauccucuucuagaaagcguucuugcaguuagauuaacaagcagauauacugaacuggugcaugaaugaauaggaaauaucccaguugcaaaggauaaaucuaucauguaguggagagcguguucaggcaaaacauuugguucugcggucgcuuggaggauugggcccgugcuauaauuaaugccacuagcaguaaaaggacauuagggaugucgcgcauguugauuauuucuucauuuuguuuauccaaguuuccccgccuuggaagcuccguggccauugccaaagaaagcccuggagacagagcguuagccguugcuccucguaagcgcaucauuaccuuccuccgaacaaaguccuuuuuuuuuuuuugucaguagagggugaaaacauuauuggauucaggaguucauaguaguccuguaugaagcuggggacggggggauagaguuaugaaauggaccauuucaaauggcauuaucuucccacagugagguacaccuuucauaaaucauaggagagugcucagaaaauagagcauuuguuauuccugcaguacauuguauuugcauccccccuacucacaggaaagaagaaauucucagguuuccuuucccagguuugaaaaggcaguuaaucgccuuacaaugaaauuauauuuuuaaaaaagguaucauaaucaaauaaaagaaguacuucauguaagucaaggauugugcuuuuacuacuauuuuuucuuuuuuuguaaucauggugguucuuuuugcccacuuauuuaggccuuaauuuaauuacggcgcugauuaaguucuuugguuuuauuuuuuacuguaaacauugugcuguauuccguaggaaaauguagaugaaugugggucauugggaaauaaaguggguggaaguauuggcgagcauuucuuucccacucucuaccucgccuggucuagccgcugauagguaguuacucuuuaguaugcccaaguucaaauuacguaugacugugauucuaacacggaagcgcccuccuuuucuaguagcuuggaugugauugguauggagaagcagagugggugcgucuuuguguguucuugacauaguuaaagaguuugguauagucaauucccuuuaaaguaguaggcuucuuaaauaauucuaguuguuccucgugcugccaagccaucuugaagaauuuuucuucauuuguaagggguuaaaagucaucaagcugauugaaaagucaagaaccucuagcgcagccuaccccuugcauauuugauacucucuuuugcacucucgggagcaguuuugaggacacacuguaaaaauguaugacagcaguuugaagauaagucuguugccccaaauaaucauaagaagaagacagaagaaaaauugauucccguagcucucugggcagugggauggggguaaagcaaggaauuaauaaaaacccaccagaauacauuauuucagacaaucaaggagagcguuacauuuuaaagguacuucaucucagaaaguuugagacauacuuuucacacguggcaugaagagaaaauggaauggaaugagcacuaaugaggaccuugaacuuaacuaacugaacuugauggucaucgcaagacauaggggagaaauauuuugagacaucauugugcaggcaaacaugagcaagaaauugagaaauccguucaugcacuucucucugguuucccggaagggaugaauuccaaaucccguggcucagguccuaggucaaagacagcucuuuagaaagagauguucuuugcuucuuugcugacugcccauccccuccucucucucaaggaaauaagauauucauuugcaaguaaauaaugcagcagucuuggauuuguaucagaucaacuuugaaugaaagccugccuuucugcguuuauuuuugcuuaucucuccugcuucugcuuccuguuuuguuaaauaagggcaaugacggcaacuauuuuaaauugcuauaaaguuuuagcuagacagcgaaucaagguggcaacacaugguggguucuuaaauaauaguugucauuugagugcuuucuauaugauguacauuucauuuugcacuuuacaaauaaccucuuccuuuuucuguuuaaucuuaaaaaagaucccgggaggcaggcguuauugugcccauuuccuggauaaggagaaugagguacgcuaaacgaguaaaaagcaacccgagauccaaacccuuuggcauucaagauuacacucuuauucacuaacuguucaucuccuccgacugcaucgccacucccccaggccagauaacccauccagaccuggagaacuccuagagggagaaacagggaggacccaggcacauaaacuugcagagcagcugaguuaucagaucuuccaagccaugggguuaucgagcuuuaucagagcagccuugcucuugcaguuucugacacaucaccauugaucaguccugggaaacaaacaaaauagagggcgauggcuccacucuguguggccccgucaauggccuggacgcagcugaaaaaauccagaagaguguaggacacuggaaaaguagcagggugugcgauugcagggaugggaccagcaguaaaagguagcccugccaagaccauuaagcuuccugcaacuccuucuggaucccacaauuugaaggggaaaucuuucccaccgcacaucacuguuugguggacuaaauggcuccccgaugucccgaaagagcacagcuucuggaagugugguauguggucccugagaugaagcagcagccacaggaacccaucauuccugcuacccaaggccuccauugccugguuuucuguugucagaagaguucauuuucagguccuucaccagauauuuuagaagcucaucaaggaaaggacguuugaagaaaaacaaauaaacaaaaacacaaaaucaaggacguauugauuucugagaauuccuccuggguuuuguuuguuuguuuguuuggggguuuuuugcugugguauugucugagccuaugauaagauuguuguugauugauuuuugucuuucaagacucagcacaacacaucccauccuucuggauaaucucuucuacccucccuuuccagauaaaaguugacucucauaauuguaacucuccccuacuuuaucagcaucuacaucuuucagccucuaccacauugaauuggaauuauaugucuguuuuauguaccaugcugugaacuccuugaagauaggagcugucuuaucuucaaggugcucaagacacguuuguugcaucaguugaauggagucaaauuauaaacaggugaugggggcaaauaucacaauaugauacucugaacaucuucucugacaaaaacugguccucaagauacaacaacauuuauauuugauuugucuugcuguaucgaaucaagcuguggucuugaguuucguacacaucuauguaagcacucugaauugagugacucuuucccaaagaucauacugggaucuuuggaaugaauggcgggucacccauccaauugcuuuugcggagauucgagcauguggggaaugcaagucacaauauccugcaaaagccaacuugagaccuccuaggacugcacugcugcuuaugacacugauccuuagcccaucuaaguaagugagcauggcccuguaagugaaauuggagagguuccuugacauucccacauagcugcuucccugguaauucaccuggguccagaacacagaagggagauucuaauugaaaaacuuuuccuaaaggccaggcacaguggcucacaccuguaaucccagcacuuucagaggccgaggcagggagaucacuugagaucaggaguucaagaccagccugagcaacauggugaaaccccaucucuacaaaaaauauagaacauuagcugggcaugguggcguacaccuguagucgcagguacuugggaggcugagguaaggggauugcuggagccugggauaucaaggcuacagugagccgagaccgcaccucuggaguccacccugggugacagagugacacccugugucaaaaaaagaaaaagaaaaagaaagaaaaagcuuugccuguauauguagaacaaaugaaaaccaaauaacaguggcaccaguucuucuuucaguuuccauggaauaucaagcacgauuugaguugagcaauuugauuugauugaucuucuuaaauguauaaucucaaacuuuacaauaagaaggcuacuugucuuuauaauugugaaauccacccuuaguuuuaaugcaucuaaagucucuguaucaaaaagaucaaaaucagguuugaaagucuguacuguaacuaaaaaaguuuugggguuuguuuuguuuugaccaauuuuuguaaaucucuucuguuacuguuuauauacccggccacuucugccaaaauaugcuggccuuuuagucuuuugguuuuuucucucuuuugguuuguuggcuuauguucgcugcuugaucugacuacugguuuuauuucuaaggauuuuuuuuuaaguuggcaucuuuuuuucuuugacuuuccuuguaugccccccuuucuccccugcauugucuugcuucauucauuucuuuccagguuccugcaaauuguuuuuauuuagggcucaucugguauguguauuauguucuugguagacagaagcugucuuuaguucguauggguugagcauggagggaacuucaucucguagucacuggauaaggagccaguccuggcucuuccuuuaacugcccuugugaccuugaacaugucaguucaucucaccacguagucauuuucucauccgucucuucaggcuaauaaucaccuguccugccuuccucacaggcuugccgggcaacccaaaagagccgcugaucugcauagcacuucgcaaugaagcugugcucuagaaacauaccacgaucuacuggacuuucuuaaauaaggugguuguucaggaaauuccuccaguuaauuuuacuuuaauucccccuacaagaaugccgagacaccucugccuauuuucucuuucuguguuuguuguuucuuuuguuuuuguuuucgagacugagucuugcucugucgcccaggauggaguacagcagugcaaucucggcucacugcagccuccaacucccggcuccagugauucuccugucucagucucccaaguagcugggauuacagggaugcgccaccaugcccagcuaauuuuuuguauuuuuaguagagacgggguuucaccauguuggccaggcuggucuugaacuccugaccugaguugaucugcucacgucggccucccagagugcuaggauuaaaggugugagccaccgugccuggccucuuucuguuucaaagaaauagucaagaaguuucuagaugcacacaaaaugaccaaaccagucuuuccgcuuauuuacacaaugaagaaacaucagaguucacccuggaagacagaguuucuuucugucuucauccuagggcacaggagagaugcagugauggcaugucuccacucugcagacauguugcaggccuggaaaacuguguggugcgucuguuuuucagagcguugagagucaugcgggccauauggaugcagugguccacagaauuggcagugagcccccgggggagcucagugcaagacaagauucuggcguaagaacugcgguagcaaggacaagagggcgucacgguguaagaauggccguggcaaggacaagaggacaucacacgaugaccuucucagagucaguaggauaguuucccuuccuggaagauugagaugaaauaaagcuuuaggaguugguaucgcacgcaggcauuaaauggauugugaagagggacuuuguucccccucagucuugucucugccuccguaaaggaguaaguuaaaaaagaaaguuucuuuuuuuaaaaaaaagccuuacugcucaauaaaucccuguggaaaaaaaaaaaagagggggaaaaaggaaugcacauuagucuuccauuaaaaauagaucaaaaaaguacccaaaagagaaaaccccauaacaaugaaauaaauuaggauaauccaacuggaggccugcaaaugaguuugcuaaauguuauauuuucucaagccacuuagauuuuuaacucccuguuucugccugaagcaauaaaggcaggaacgcugucauuagcuucaaacaccauuuuuuaagccccuagcugcauuuguuauuuuucucuucccccccuuagcuguaucccugcauuuauuacagcgcaggugcaucuugcuuuugagugcuaacugagaugaaaggagugaggaaacgcucucuucuucuugcaggggagggcuggcaaauucagugaaugcagagucggcugggagccuuucggcuggaaagcucuuccucugaugagcugucuguuacagauuuucagggauggcccuugauaaggcaggggugucuguccacgccacacuguggucagauaacccccgaucguaauaagccggaggauaaucgcuugcauuguucaauaaagcaauugcuuuguccccucacuuagccccuucagaaaagccaaaaagaaugugccaccuagaugcuauuuauaaccauuuucaccucuugccuccaggggcuaaauuggaaaccuaauuuuagaugcauaaaagccaaaauauguauaggagaagcuccaaaauaaaauaucccagaguggcuuguaagcauccuuccaacagguucagguugauuuaccuugcuguggauauuuaauuaugucauugaaaaaaacaccaguaauuaaaucauuauuucuuagaugugagguccaaggacauucuagaggaagucaaaggcagagggaggaagggugggacgauggaggccugaagggcugguggagaggaaagaaggcagccugugccgucagagagaguucaacuccauccgugcagcugcuagcaucuugccuuacucagccucugugaaccuuaaguugcucagaaugagacagguaacaccugccuccgugguuugucaggacauuuagaaaugcagacuugcucaagaccuggaucucaggugguagguugguccacagacaguggcaccacuagcuauuauuuauuuguugucacuguuugggaccccuguugcugucucaccaaagaacuucuugucucccuuuuagaaguuuccagagcgucuuccugauguugcauagagcacucacaccuaacagaucucagaacuuguaucuuuucuggguggcuagacugaaaaauccauuuucuugugagugagccagaggucugucucuugcggcauuucugcuuuugagaaccucccguuuccugaaaggcaccagaccccaagacagcucugcugccugauugguaggugcccaugacagcucugcuucaugccugcugccuccucaucccucuggaugccuugugguccugcuugucugaagagcauaaacuuggggguucccacucgaaaagagguuccagcaguuccagccccuaugucaggggagccacuuuuggggcuggugguaggcagaacuuuggcccucgacaucuccucuguuggcauuacuccuauggugguguuacguaacaugacaaaagggaccuugcagauguaauuaagguaacuaaucagcugacuuuagaauaggaagguuauccugggugauuagcauggaucagaguucucacaggagcccuucaaagcagaaggggaagguggacaagagaaucggagagauguggcagaggguaggcagagagauugcaagcagggaaggauuucacguacugccacuggcuuugaagauggagggggcacauggcuagaaauaugggcggcccucagaagcuaagaacuagcucuuucugacagccagaaggaaauagggaccuuccaccuacaauagcauggaaaacggggaccucaguucugcaacugcauggagcugaauucugccaauaaccugaauagguuuggcagcagauucuuuccuggagccuccaaagaagagcccaggcuggcugacaccuugugaguggccuugugagaccugaaacaggaaacccaccugagccacucuuugccugggacuuccaacccacagcaacugugccgucgugacuagauacguuuuuuuaaggggaugauaauuugcuguggcagcaauagaaaaucugauacacugucauggggccuuccacaggguggggcucaaccagcccucagcucaucuagcauguuuccuccuacaaccuggacuuuuuccuguuguccccucccgugacacucagcucccugcauucaauagaauugcuuuugugggaugaugaguguguucagagucauacucagccuaauuauugcuuuugaccaaccccaacacauaaugcuguaugucaugcuguacuacuuuuaauuucacagaugaacacauuucuguucuuuuaauccaccucuccaaggcucguguuaacuccaucuggacaaagccuugagguauacguguggcuucuuuugagcaucgugccauagcugucccugaucuaccuugcggggcaaacacaacaaguaaaagguuuuccucuugaaggauugaacgccucaaugcgugcauccuacauugucuagugggagaaaucuccguuguagauucugacaugucacuccacaucuuuguaacuuuuuauggcucucagcccuacuuucuuaauaguagcagcaguauuuaucuacuguuuauuguauuccagguaaaggauaugugaagcacuuuucaugcauuauuuaaccuagcuauaauacucccauuugacagaugagaggacugaggcuuguagacuuuccaaggcugugcagcucuaggucuagucugccauuugaauuugggcgaugauaccagagaccaaguucucaacuaugauauacugcacauguuuuuguuuuuguauuuugguucaaaaagagaguaugaucucacuuuucccuucuugauagguuguagauuccaugucuaauccauccuuuuccaauauucccuccuaaucuuucaguugaauuacggucuuuagcucaaaugcaugacaugaugugugugccuuuggaguggggcgguauuagucagucgaugguuauuuccuugaggagaaaggaaaggagaaguugaguacuuuucaguguuuguuacuacaaaagcaugguggcaugccauuguucugagaggaaggggcuuuuuugccuugucagcuccugaugaaaaagauguuggguuggaaagcuaaguuacagcaggugaacuugaauuugaggaaagacaaagcaaacccuggcuauuaaaggaacacacacacacacauacacacacacacacacacacacacacacacacguuucugguauuaggaaauggagauuucuaacauaauaaaaaagauugaacuuaaaaaugacuuccauuaaauaggguaagaauuuugagguggaauccuuuuuccuugggucaguacuuucugcaagcuucuaaguaaugguuucucuuagacacucacggugauaaaauugggaguuuucaaaugaaaucuggaaugaucuacuggcaucaugccuaggacuuuggaaaacuugaagguuggcaccuuuggggaaaaccagacuuuugaagcaggggcucugauugucucuucuuauuauagugcaagguguuuggcagaggugugguagcugaaggcccaaggauaacauuguccagauuuucagucuuuggagccauaaacauccgguucuuuccagccccgcucaaccgccucucuuaauucaccacccuguuagcuucaucucaggccagacauuguagguggcagcaauuguaggacaaugagaagaggccagaugaggacagaauuuuuauuuuccauugccaguaacaaacacagcccuaacuugcuuagaccaaagauggggauugauuggcaacugggaagccuaaggguggaucuggcguggcuggaucuaagugauuaaauggcgcggucauaauucuauuucucugcaucucucagcuguacuuccaucucuguaaacuucauuugcagacauggccagcaugcgcccauagccuuaaugcucagggaauauuggugggagagaaagcuccuuuccuauagcuucaagcaagagucccacggcugacucucauuggcccucagugggucacauguaaaucauugagccaaucaccgucuuucugucuggaccuggaauaaagaccaccuuagagcaugggagcgggauccccuugauccacaccauauagacugugagguaugaaguaccucacaguaaagaagucauguuauugcuggaaaaggggacauggguauuaaaaagacaaaaacaacagggcuucaucacagcagcuauacugcuccaucaauacccaucccaggagacaguggcagucuugaugucaaucuuguuuuaggaucauugccaguggaauucaggacugcgguucuacccaguaccggggaaccaggugaggggguuaagaggccugggcccauggaaggggugagagagagccacauacuuacaguugugaagggggccagccaggaugguggcuugcaggaaaggucugagcagaguaagaggcaguuccuggcaccagcaugccaaaggcagauagcaacacucuucaauggaugugggugagaggacaguggaauccagcaggggccauuguuuccuuccauaauauuuuuaaacuguagcaaagugaucuuuuugagacccaaaugugaguaugccauucuaaucuucccacccucagauaaaccacagcaaugauuuuauacugucuguaggguaaagacagaccccuaaucauaaccuacaaucccucgacccagugaccuagcccccguguaccuucccugucucauuucucacuguuaucauuguaacccucuacccucucuuuuggcuuccugcaguugcccuccugcagcagggcuuuugcacaugcugguuucucccuuacuuugccucuacucagucuuuauauuucaacucaguggucacugucucuaggaagccuuccaugacugcauuaaauccuucuauaaguuuucauaguucugugcauuuccucuuggcagcaaugcacugagcugcaguuuuacauuuuuguuuuuuuguuuuuugaguuuuuuuuuuuuuuugagacaaaagucucgcucugucccccacgcuggaguacaguggcacgaucuuagcucacugcaaccuccaccucccagguucaggcgauucuccugccucugccuccugaguagcugggauuacaggcauguaccagcacaccuggcuaauuuuuguauuuuuaguagagacgggguuucugccauguuggccagccuggucuugaacucuuggccucaagugaucuguccaccucugcuucccaaagugcuggguuuacagguaugagccaccacaccuggccuguuuuuguguuuguuuauuaauuccuauuuuucccaccugacaguacgcuccguagggcauguguuuguuucgguuccccaacguaucccuacugcccagcagaaggcuuagcuguuaacaaguguuuauugaaugaguaagugaaugaguacgugaauaaaucugcgcuuuagaggcacuugcucaggcuuguggaauaauucuacagagagaaacaggaaucaaagggaaaccugaagcuggcucagaagauggaugggccagcaaaggcuucagcaaaaccacacaaugcucaugaaaaaucacgcauuucucugauuugugguuauugcuucccuggauuuuuuuuuuuuccaguuguuguuguucaugguggugguggacaaucugaccauauaccaaccaaauugacuguuaaauucaaucaucagugaccacuccugauaaucugaccuccuaaguuagagccccugggaaguucagccgugguucugaccaggcaggauaacuaucuaaguguuccccuuuggaccuagacugagccaaagauucuccuuggucuauauaggauaauagauuucuaaaacaaaccaauagcucaggcacaauuauagugggggguggggggcauguuuaaccuacuuuagagaacaaacucuuuuuaagggcuuugcacacuaauuguaugcaaauggaugcugcuaauugcaaacacaaaauucaaaccuagucaaauuugaaaccuguucaucaacagucccuuuaggaccucugccccacucuauguaugcaguuuaaauugcugauuuauggcuacauaaugucuuccuaacccccaguuuacuguuggcuuccuucagagucauugccccaggggacucauugacggcagagaguguguccccuccacuguugccucaaugcccagcucagcccaguggguaccguacuucaaaaccucuuauugagguccaccucugugccaagcauuucgguaggcagugacagaagagagugcaugcaugaauggauaaacucuuuccuggaaugccugcucucaucaccugguuucaaagucgagccagacguucugucucagcucagauucuaccuacccugagguucgcagcugggcaugaucgagccacucuccacucuccuguagcauuuuugggcuuugaguuuauuugacacuuuucacuugcugccuuauauugcguuuauuuuuauuaauuacuucaguagucauuuacaaaaugcugcugaauccaagucccugugcaagaugcugcaggagacaaaaagaugaacaacacguggucuuugcuuucauagguuauuucuccucuuccauagcaacacaugucaaggcaaggaccauaucuuauucaguuccuagucaucuuuucuuucuuuugcuuuuucuuuuuuaaauuguuaagaucugccauaaaaaugucugucagaguaggcaugauugcauauucuuuagauggauggguggauggauggauggaugguuggaugguuggguggauguaugguuggaugauuggauggaugaugguugagugaguggguggauggauagguggaaggaugaauggaugcauggcugaguggauagaagguggauggauggagggauggaugguuggaugguuggauaauuggauggaugcauggauguuuggguggaugaacagaugaauggaugcauggaugaaugaguaguuggauggauggauaaaugaugcauggauagaugaauggugaaacuuuuauauuuuacuaaaaaucugcauugauagccuaguggcuugcuaaaaauaagggagcugcccaaaugccccauuuccuuuauauacuuguggagcagcagcgaaggccaagccagugccaggggcuggaaacagacacauaaauaagaacaaauaagauacagaccugaccucaaugauuuuuugauauagaagcauaggcacauaaauaaauuccuguaaugggagucuagggugagggguggugggugccauaauaaaaauuauauaaagugcuauggggaagcaaagcuacaugaccaauuuguucuauuuauuuauuuguuauuauuauguuuuuugagacagagucucguucugucacucaggcuggagugcgguggcaugauuguagcucacuccagucuugagcuccuggacucaagagauccuccugccucaguuuccugaguagcugagaccacaggcacgggacaccaugccagucuaauuuuuaaauuuuuuguagggacagggccucacuguguugcccaggcuuaucucaaacuccuggcuucaagugauccuucugcauugucccccacaaaguauugggaauguauucuuuccugaucaggaaacuccgcagagagaaagugacaguugaagacuauauugaauuuuggcccacaggaaaaggaaacuuugcuguuagggucaccuggaggagagacugcaggggucagagaucagggccauaugcuagagcugcaaugugggugcucaaaugauguucagugcaucuucacagauggaccuccacaugucccucaugcccuaaaauagauauucuccacagcugcacauacaacaacgucagugaaauccguugagaggagcauugaggagaugagucaggugugccgcagcacucaggucagacuugaggcaagugagaggugugaguuauucagagucccagagagcuugggccaaaagagauucuauuuuuacuggagcaugugaggguggaucacaacuaggauggcgcgaaguucaccucguguaagcacaccaggcugcagggauaauaacugcacuuuuuaaaaccagcaaaucauucauauuuacuuuaugaaaccucuuuuaacuuuauuuuuuauauuuuuuuuauuuucuuguuucuuuuuauuuuuaaaauuuauuuuuguuuuuuuuguuuugagacagggucuugcucuauugcccaggcuggauggagugcaguggcccaaucauggcagccucagccuccuaaacucaagcaguucuccugccucagccucccgaguagcugggacuacgguuguacaucaccaccucuggcuaauuuauuuuuuguaaagaugaggucucacuauguuucccaggcuggucucuaauuccuggccucaagcgaucucccauccccccucagccucccaaagugcugagauuacaugcaugagccaccaugccuggccucuggccuucuuuucacuuuagaaaaaaacaaaaaacaaaaaacaaaaaaaaacacaaaaaaaacuuuuuuuuuuagaacuguuuuaguuggggagccaaaauugagcagaaaguacagagaguucccguauaccuccggcagagcccuggcucacuaucuacauccccacuagauccauguauuuguuuagguuuuggggguuuguuguuguuuugagauggagucuugcucugucacccaggcuggagugcaguggcaccaccucagcucacuguagccuugaccucgagggcucaagcaauucugcugccucagccuccugaguagcugggauuauaggcacaugccaccauacccagcucauuuuuuuuuaauauauauuuuuagugaaggcggaguuucaccauguuggccaggcuggucucuaacuccugaccucaagugauccgcccaucucggccuccccaagugcugggauuacaggcaugagccaccacucuaggccuguauuuguuuuaauugauuaaucuacaaugacacaucaucaucaccuaaagucuauagguucauuagguucacaguuggugauauauauucuguggguuuucacagacauggaaugacauguaucuaucauacaucauauauuguaucauaucauaucaugucauaucauaucauaucauaccgaauaauuucauugcccuaaaauaccucuguuuucacuuuuuaaucucuuugugcacacaucaaaaauuccuuuuguguuuuugaguuucaaaagugugccacaaacaagaaauuugggaucugcugagcccagccucagaccuguaggggaaacaaagagggcaacaggaggucacgaaggcaugcugugcccacuuuuggaaauugugaaggagagugucucaaacauguaggcuugagccacucaaaauucugggaaauaggauguuuuguaaagaaaguuugcuacugucacuucugaguaguugcagucccucccaguacguggguaucuucggugagaacaaauuuccuggcagcuugaggacuccguguguuauucacaugcuuuauuuaauagacuugccucaugugacuuucuauaucauccuuugugucuaagugauuugcacugggaagauaguaaacgcucccacuuuauaugcagaagguugaaaacaccaugaguguugcaaucugagguaucugcccuuaaagaagcaauauuuacugaaaugcagggcacacgacuuuuccagcaaaccacaccgccguccuuuugugugacgaaauaauuauuuugagauaccgacaugcgugacgaccagauaauuaucugagaaaacuuagcaucuaaugaugcuguuuugagaucacaagaaagaauuauauuagcuugagcugaauuguucuuuucccccugucucucuuuaguuguaaaaacacccacaaaugugaaugcuucaggccugaacuugucaacagccaguggcucauuguagacauagggaugucgccuguguuuggggcugagacaccagaacagguguucugugggaacugagaaugucuacugcugcacaccuuuaaucucgggucuucuuucuggugaaauacccgugauucauaacucagucacguuacugagguaugucucuucggauagauucuaucucuaaaaacuacagauucuaucucuaaaaacuuaagucaagggauuuucaagcaguuguuugauuuauguaugugaaccucuccguuaggagaagaacuuuucuuuggcaaacaccauaggaacggagaccuuaacaaaagaauuaggacucucuuguccuguuuuaaucucaaagcugucccugcgcuggugcggcuggcccacuugugccuuugugaauuugcagagaagaggcugggcguggggggacacaugacuaauccgcccuuucuuuuguuugugcaacaacucaauucacugucaccacaucagcacauuugcugcaaaucucagugcccucucacuuucguuuuauuuaaugcguuucuacauuuucccaaggccacaugagcuguuuucuggcgcgugguaugccugccucaaauaacuaacauugccugggucuuggaaucugagccuucauauucuccgauauauuauuugguccuauuguuccuuaacuugcucaucauucacacggcgaaggaaauuccauuugguccuuuuaagaccgccagacuagcugacuuaaacacucagcuccagcuacuucugaauauuucgguucuuuauugaaaugguccuuuuaaugucaucuuuaauuuaaucaaauagugucaucaaaauaacauuuacucuauuacugaaaauucacugcauuauuaacuaguguaacuagacaaaaaagaugguacaaacccccauggaaauauauacuuacuguaaaaauggauagaguucauggauguucuauauuuaauuugcacuuucaaaguacucucuauggagagguuuuaugguucugaaauaauuuaaaaacacacuuuacuacaauccauagcagguaguuuugccaauuugggaaguuauggugccuugcaguuuccaaaguaagcugaacaguguuuuuuaacagugcugccccucucucccacuagaaaugcgaguccauccuuuuaccaagugugguacaacaaagguuucucugguuuucuuuugguauucucagacaacugaaauauaaauuacaugguaugugcagguaucaccaggaugcaauuaguuugaugaaauauaccaagucgucaaugccacuuuggauaguuuaaucugaaaauaggacaugguugggguagugggcacaggggaaggaagguuauguaauuuuaaaauucuuccuuugauucaaaagaaaaaaacauguuuguugcauucaacuccauagggugagcauagcuuaguggggagagauuuggacuaaaaaauaagaguucuggguucaagaucugagguaaauuauuugcuaggccuuaguuucccaucugugaaaaaagggaguucuauaacagcaagacauuuaauauuaaaauaauguaauguuuuuaaaaaugcuugucuacccacuuuuucuugagauuaguaagaccaucuuccaauuagaauguuuauccgaacuuaccgcuagguauuuccuuguagaguaugaaaguaaaauaucaaugggccaucucuacgucaagguucucguucuucucauuacugagaaauuauguuccuggaauaauauuguacagacuuagaaauaagggcauugaacuuaauucauuuauuuuucaaaaggcauguauuuuuuaccuguugcuauaucugcugccagccaagugcugugcuuggcccugagaaagcaaagagagauagagauguccauguuuuggaacuugacguccauuaggggacauaaacauuugaaaagauaacacuaacaagcuaauucagguaugauaauaaaaaccuucacaggguuagccauccaucuaucuguccauccaucuauucacucaugcauucauccaccuguucauccauucaucuguccauucauccaucuauccauccaucuacuucuagguugugagaacccguaguauugacucucagugugauaggaaggccagugucuuggugaaagaucaaagagcucaucaaaauuugucggauagacugcaggcucagacacugaugagaccccccugcaacuaccacaucaaaaggccuaggagccuuuccaugaccaaaugcccauauugaugaauccgagacaagugagggaaagauguccucugucgguguucugaacccuguggaaaucauacggggaacuauaaaagauccugaugccugguuuucuucuggagagucugauuuaauuggauaaggauacagccugggcaucaagaguuucuagaugaccuaaguaauucucauuugcaaccaagguugagaauaaaggguguguauaaggugagagacuucugguuaacuaaaggaaauaccaaugacauuugugcuuuaggucuaccaguuaguggguauuggugcauggugggacagacuaaauggcuacaggucagggucauugucaaagagugagggauaagggguugugcuguggcucagaggcagaguagacugaggaagaacagcuaauuccagaaagccauguugugguguaaaagauaguaccugacuuguaaugucugacaccaaaaaugaccuuaauuugggucauaggacaaagaccuccccaccuccagcuaugaaagacagaaaaugauaggacuaggcuucauauuuucuagcguaacguuuggcuugugguauauucaaaacuaaguccguguuuguugcugcugagugacugggcugauacuaccuguccuucagccaucuagacuugcucucuaccauccucaauacuucauaugaaaggagacugucacuucaugaaaaucauuuauuugcuuuagcuuaaaucuacuggagauuacaacugccucauuuugucaccuucuuaccccagaaggaaauaucuccacaagagagcagguauuuauugaguuaugacugucaggcauggaacagauccauuggucagaaauaaggaaauugucucuaccuucaagguucucacagucuggagggaacagagagccaucagggacaauaggucccugugccaucagcuacugggauguaugacuuuccaguagagguacacagcacuuguuccaaaaggagccuauguagcuuugggaguucucuauuuagucaccuuauuuuuuuugucuucuuguuaaacuagcauccuguuuuacugaaucucugccucaguugcuuuauuuacuguauacauacauagcucuuuugaagacuugaugucaaaaguaaagaaguucagaaccuacggggcuugcuuugggucccaaauuaucuuagcuuucuggaaagagaagaaucuauaauguauucuccauggaguaucuuuacucacuugugaugagaugucuguaaaaguaaucagcuccauacaucugggcaugaugacccucaggcccuugagacucagguguucucagcucauggugcaaguuccccugaaagaaagacucaagccaagcauucaaugguuauguuccagaucauagucuccuaaaagccagggguccuuuaugcagggauggugacaucagaaguuaaaaggucuaugcagauuaacgaggaaaaaugagggaaauuacuguaagguuuuuaaaacaugauaguuauauaugaacugaugauuauauaauugaacaugccuaaauugauguaguucucuguaaaacuaguugguguaaggaaacuuggucuuugaccaucaaggagguugcaguuuguggcauggcacaaagauaacacucagcagauauauagcuaugggauacauggauggauggauggauggguggauggauggauggauggauggauagguagauggauggaugcguggguguguggaauggugggugguagguggguacauagauggauguauggauggguggguuggugggugcauggaugggugaguaaggggggauaaaugaaaggcuuguucuucugaagggacucuuuacaaagagucuuugaucuuccagcuucacgugcaagagaauccccaaggugagcuuguuaaaauaagcauauucuggguaucacuuccugauuuucugguucaguaagucugaggaggaacuuggggaacuuuaucuuuuaaacaaguaccucagguuaucauaguagucuugcuguccugaaucuuaaugcaucucuauuucugcuacaucuuccaugaaguugauuuugcagaaaucauucugugguuccacauugacugcauccaagaccuauugccuucagauuuacaucaagcacaauuuggcagguauuagggauggacccagcagccaagucuuuguugccuuaaacagaucccuugucucuugucaggaccuccuuccaggcugcuccugagcaagucuggaugugacuucuaccuaugauccaguggguugggccauaaaggagcuuuggaaagggacagucuuagggugaaaaagagggagaggcuugccaucugaacaggaaucucucccagaggagagaagagaagccuaggcuuuaaugaggacagccacccuguggaugacuuucugugugauguuauguggagguggcuucuuuuuucucuaucccauuagcugaauucugugccagaaggaagagauuuggagucagcaaggcauccuuuuuuuuuuuuuuuuuuuuuuuuaaaaaaaaaaaaaaagaaggaaugugauugugaaggaagcaagaaaaggcccaaaggcucuggacaagggcuaggaggcugaggaguuuuacacauucauaauuuccuuguaggccaagcuuacucucagggaugacagucauuuucuaagaaagugagauugcuucacauugcauuuaaaggcuuaaauaauguauucugucagacaauucucugaaaugguuuuccaagugaaugcaucagaaagugcccagaaagaaugccuggcacaggaagaggagggcauucagaaaaugugagcugcuugcaucagaaucuaacuugagauguaucauuccuacgguaaggugcacacacauuaaauguacaguucaaugaacucauacuuauuuauacaacuguguaaacaccacucagaucaagacagagaacauuucuaacaccucagaaggcucaucuguuccccuuucuaagcaagaaguaccaucagcauuaagagguaaccacuauucugauuucuaucagcauaguuuucuguuccugaauucauauaaauagucacccaguacgcauucuuugcugucuugcuucuuuuacuccucauuagguugugggauuugcccacgauauuucauucuuuauugucauucuucuuucucugccacugccauccuaccaacaguuuguauuaugaaaaauugcagacguacacaaaaguugaaagaauuguacuguaaguacucugauaugcaccaccuagauucuacaauuaacauuucccucuauuugcaucucuauccauuuaccauuccucuugucuauccaucagucuaucuugauucauuucaaaauaaguuguaggucaggugcaguggcucacaccuguaauaccagcauuuugagaggcagaggugagaggauuccuugaguccgggaguugaagaccagucugggcaacauagugaggccuuaucucuucaaaaauaaaaaaaauuagcugcccauggugguguaugccuguggucccagcuacuugggcagcugaggcaggagaauugcuggaguacaggagauugaagcugcagugaacugugacuacacugcugcacucaacuugggcgacagaguaauaccccgucucagaaacaaaaacaaauaaacaaacaaaaagcuaaauaaguugcagacagcagucgcuucacuccuaaacacuuaagcaggugugucauccuugaauuacugaauuagaguucaguauuugcuuaugcuaguuauguuagugguaugcuuuuuaaaaauaauuaaggugaugucaugauaaggcuauuaagagccaacaugcauugaguauggacuuucugccagacauugcacuaugcacuuaacacacagacacauauuguuuuuuccauuuuaagauacagaaagugggccuuaaaggugcuacugacuugcugauaugcuuuggcuguguccccacccaaaucuuaacuugaaucguaucucccagaauucccacguguugugggagggacccagggagagguaauugaaucaugggggcugguguuucccauguuauucuuaugaaagugaauaaguuucauaagauccaaugaauuuaucagggguuucugcaguuuuucucuugccaccaccauguaagaagugccuuucaccuccaccaugauucugagaccuccccagccauguagaacuguaagccugauuaaaccucuuuuucuucccggucucagguuaugucuuuaucagcagugugaaaauggacuaauacagugaauugguaccaguagaguggggcauugcugaaaagauaucugaaaauguggaagugacuuuggaacuggguaacaggaagaaguuagaaccguugggaggucucagaagaagacaggaaaaugugggaaaguuuggagcuuccuagagacuuguugaauggcuuugcccaaaaugcugauagcaauauggacaauaauguccaggcugagguggucucagauggagaugaggagcucguugggaauuggagcacaggugacucuuguuauguuuuaacaaagagacuggcagcauuuugccccugcgcuagagauuuguggaacuuugaacuugagaaagaugauuuaggguaucuggccgaagaaauuucucaucagcaaaacauucaagaggugacuugggugcuguuaaaggcauucaguuuuauaaaagaagcagagcaucaagguuuggaaaauuugcagucugauugugcgauagaaaagaaaaacccauuuucuggggagaaauucaagcuggcugcagaaauuuguguaaguggcaaggaaccuaauguuaaucucgaagaccaugaggaaaaugucuccaggccaugucagagacuuucacagcagccccuccuaucagaggccugaagucccaggaggaaaaaaugauuucaugggcccagcccugggucccugugcuguguguagccuagggacuuggugcccugugucccagccacuccagucauggcugaaaggggccaagguauagcucaggcuguggcuucagaggguggaagccccaagccuuggcagccuccaugugguguugagugugugggggcacagaagucaagaauugggguuugggaaccucugccuaguuuucagaaaauauauggaaacaccuggaugccccagcaaaaguuugcugcauggguggagcccucauggagaaccucugcuagggcagugcugaagggaaauguagggcuggagccuccaggcagaguccauacuggggcacugcccaguggaucugugagaagagggaaagugaacuaagcucuuuaaaccucauauguuuccaucaguaacaugggaacaauaguaacaauuccacagagauaguauugaugguugaacaagauguuuaaaucacuaguaaaauuuggccagacacgguggcucaugccuauaauccuagcacguugggaggcugagguggguggagcaccugagguuaggaguucgagacuagccuggucaacauggugaaaccccaucuguacuguaaauacaaaaaauuagcugggcaugguggcaggcacuuguaaucccagcuacuugggaggcugaggcaggagaaucacuugaacccggaaaguagcgguugcagugagccgagauggcaccauugcacuccagccuggguaacgagcaaaacuccaucuuaaaaaaaaaaaaaaaugcccgccuuauucagauacacagucuaaugcuuuccacuagaagauucuggcacuguuagcaucucuggcauaaacuauguuacucaacccaguucugucgucgucauuuuuuuguguuggcuuugcccuucccgcauugugacuugaucccauuuaagcagcaaccucugcacacacaaucuuuucucuguccuucacucagugauguuauaauaucuagaggcuuauugauuauuuguuugauucuauugugggcacaggagcaguucuuagauuaacacuauuagauuuucccaagcaguauugccgugguuuauacaauuggacgaaaugggugaucuaauuuggacucaauuugcuccaaaguagaguuggaggaaggagaugcugugauuugguucugcaccugagaacaagaauggaaaaaguuaucuccaggugcuaucugugugccucaucaauuuuggauacacugugugaccagcucugaggauuccaagcuuuuuugcguggcuucuuaccuaucagcuaaagaaccuagcuuuacuuauccaacuuagauauuaaaucccaugauauaauuuauuuuuccgugugaaauaucucaggaacaaaaaagucagguugaguuuucuaaaggcacugguuuaagaggcuauagguuaagaggagauaacagacaugcucagaaacaaaucauuuccugauagcuguuucagauggaaccaaauggaaaacagugcuucuuuccguuuacuguacacccccuauccuggcaucuaaacauauuuguaaucauacugucuauagaaguuuugguucugcuuuugaccuuaacacuaaaauacccuuccacaauauuauaggcuuuucauguacaucguuuuuaagauggcuauaaauuccacuuaguggcuaugacuguaguuuuuuuuuuaacucuuccccuaauagugaaaauuuagauuguuucuaaauuuuccuuacuauaaguaaggcuaaaaaguaacaugugaauguuuugaaucaauaaauauaguauguauuaauaauauugagcuauuucuuaagauuacauuuucagaaguaagaucacugagucaaagggugcacacuguuuaaaggagcuuaaauauauugcaaaacucuuuucauggucugcugauaucacugaaaauggaggucuggauucaaaucacaugugccaacuguucuacuuuggcagaauuaccuacugcuuugggccucggguacuaaauuugugaaaugggaaaaauaauaguucccaccucauagaguugcaguggagauugaaugaguuuguagauaaaaagcgucugcguugugucugguacaugguaagggguucguaaauacugaguuauuucuuauuaacauuuauuauugucuccacuggaagaagagccuguagaauaugcagacuauucaaaugcuuccuuugguccauuguuguccuuucuuuucucuucuagaacuuuccccauagucaugcaucugucccuggguuaucugauauguguuucagccuguuuucccaaguuuaccugccucucugagaagcccaucagcccugagagauaccuggaaggaaagaggaaaaugcgugauucaaaucauguugcaaguggaugaaucuagccccaaacaacugggaggcaacuacuccugccugccgaggccuuuuuuuuuuuuuuuuuuuuuuuuuuugagacucacucugucacccaggcuggagugcaguggcaugaucauggcucacugcagccucccgggcucaagcuuuccacccaccucagccuccugaguugcugggaccacaaguaugcaccaacaugccugguuaauuuuugugguuuuuuuuuuuuuuuuuuuuuuccugcugagauggggauuucaccauguucuccaggcugguuucaaacuccugaguccaggugauccacccaucuuggccucccagagugcugggauuacaggugugagccacuaugcccaauacccccuauguagacuuuuaaagaaauacaggaaacagccaagacuggugucauucagauuuagcuugggagagucuaguggguguuagguucccacaggaugaaggaucaccaugaacggucaggaccugacuuaggaggacucagaagcuggagacugcagaggauggcacagaguuccaaaucuuugggguguguaagaguaggagaggcaggaugggagaggaugggagugaugccacauaaaucaacucuguugcagccuccggggccacaucaguagcugcaggaggaggagggaacagggagacagggagccuuucuuccuuuccucacccccaguucuguguuuauacuucucauuuagcccauaccccacuauauuaaaagaagauguauaaguguauguguuuaaucuaccauuccuuguggcacagugcauggucugcauggcacaguguguggucuguauggcacagugcaugguccgcauggcacagcgcgugguccgcguggcacagcgcgugguccguguggcacagcgcgugguccgcguggcacagcgcguggucugcguggcacagugcguggucugcauggcacagcacauggacaugauucauacaugcaagugaaugagugaaugggcgauuuccagacuauccagaaacugugccccauaguccuacccguaggaauccaacagggaacugucaccaccgacccgaggcaggaaccaugugcucugagcccuggccauuuuguguagauggagauaaauugucauugcuaauugccagagaccagguccuggugguagccaaacuguucccuagggaguucucaccaaccuugcaaaaugagauggcagucuucaucguggaugcaauuauguuucauuguuaaccaucacaagcaacgggacauuaugaugacuguuauaaguugguuucacauguaaacuuugaccucagagcaauggggcaggcuuuucccaaggacccuguugagagguucaugauggugacaaaaagcacaagccccagcugccaaggaggcugauaucgggagaggcagaaugugucuuuucuuucuucuuccucuucuucuucuucuuuuugaaaccaugcucauugguuuuaggaaucauuagcauggugaagauuaaagcuauuggagauagcacagauuguuucauuuuauuauguucaauuggauuggauccgagccauuugcaaagugcaguauuaccauaagaagggacuuggaauguuugucacauaauacuucuucauggagaaggcaguuucuuaaagaaaaaaaaaaaagacaacuugaaauagcacagcuuuuuuccacuuucaaauguauaacaaaauagaacuuuauauuuccagauggacugccuggaacccggggaguggcucagcuaccaggcuccaguggcccuugucuuguuauuuccuccauuagagaccuggcguauaauugugggagggagaagccaguggagcagucaggggacucccuggcuguuucugugucuggucuuaugggucugggcacugaauucagucacaaacccuagcaugcuccuuugcuaccucaggggacaaagucaagaaaauaacacuaggauugccacccugcucucucucucucucucuuuuuuuuuuuuucuuuuugaggaagggucucucucugucaccuggcuggaauacaauggugcuaucuuggcccacugcacccuccaucucccugguucaagggauucucgugccucagccucccgaguagcugggauuacaggggcacaugccaccaugcccagcuaauuuuguauuucuaguacagacaggguuucaccguguuggccaggcuggucucaaacuccugaccucaagugauccaaccgccucagccucccaaagugcugggaugacaggugugagccaccacacccagccacucucuuucaacuagaacaguuccucucuucuuuguugcauauuuuuguauuucaugcaaggugcuguuuaugaacaagggaguuuccugcagcuuuaauaaagaagagaaaagaaaagaaagaaaggaaaauucgcauguugaaaacauuguacuaaucaaaaaagccagucacaaaggacccuauguuauaugauuucauuuacaugaaauaccccaaagaggcaaaucugcagaaacagaaaguagagugguugccaggggcuggggauggggcguggauggaggcauuugggauuaacagcuaaagauagcaggauuccuucuaaagcaauaaaaauguuguaaaguugauuguggaaauucuuucacaacucuuugauuguacuaaaacuuugaacacuuuaaaugggugaauuguaugguauaugaaucauaucucaacaaagcuguuaaaaaauuguaugaaaacugugaugggauucaaguagucuaacgcucaaauuucccaagugcccucauuuaagucuggaccacgacaggaacccagauguggccugaguagcacaucguggaaugggccugucaccucuaccccacacauccuccugcuguuaaugcccccuuugaaagccauuagcucuuuugauaaccacagcacgguguuggcucucaguuagagacucagauuuaucccugcccgaaucauuuucuuugauucucugcccuuccccacuacaguguaaacuccauuuggacuuucucuaguucacugugaaugguuuuugaauaacaucaauuagcauaaccucaugcccagcaucguccuuauuguugagagcacagcagugacaaaggugcaacucuugcucuugagcgaucacaguuuauuuggggaaccugguacuaccuaauaaaaccaggggagacucgacccaaggcauuguguuugagcuaggcuuugaacaauguauagacccucaccaaguauggaaguggaagaguaagacauucaagguagaaggaacaguaugaggaaagucagagagcuaacaaagauuauaguguaaugccagaaucaugagaaauuugcugagaauucauuugaggccauaauuuaaaaagauaggaggagccauguguagaacuuucacagaacaguguguaccuccccuccuucuuccuuauuagucgugauucuuggggggcaacuaaacccagcuuuuggcaaaagggaguauguugguucauguaccaggaagucuuggagugauggcuucaggcacggcuggauccaggggcucaaaaauauaaucagaugauuuguuugcuucugucuuuugcuaugguggucucuguuuugcuuacuucugcagcagauuuucucuaccuggugggagaaacagcugccagaaaauccagauucccauucucaugcuagcuucauaacagcaggagagcuccucacucuguuucccaggguguauauauauauguauacauauguauauguauaucaauauauauaucagguaagauucuaguccagugugagccauaugcuuuauuccugagcaaucgcuguggucaagagauagacuuuuuagggccgggcacgguggccuacaccuguaaucccagcacuuugagaggcugaggcgggaagaucacuuguugaggucaggaguucgagaccagccuggccaacauggugaaaucccaucucuacuaaaaauacaaaaauuagguggcaggcacuuguaaucccagcuacucagaaggcugaggcgggagaaucuguugaguccgggaggcggagguugcagugagccaaggucacgccacugcucuccagucugggugacagacucugugucaaaaaaaaaaaaaaaaaaaaaaaaaagagagagauaggcuguuuaacaggugucguaggucauguaucuacagccauggaaagagaauggagcacucuaauggaucccugacgggucaaauggagcaaagugugcuucccagaagagcauaagaaaaaggaaggguacuggguggaccaaaucuauuguuacaauaucccuuauauuccuuaggguuccuuuuuuucaaguuaaagcauugagucaugucucugauaaaucgcccccccaccccgauccccacccucugccgcccuggccuucuuuuugugcuguuggguuccaaacuuuaccugaggauuuucacaugcacaucuguuaaaugccauuuaaagagaacacuaacaagagaaagcuaguucauuuuucuuccugggaccucaguuuccucaucagcagaaucgggauauuagugcagaccuugcaggcucuuuaugaggauccaucgggagccucaggcgcacacucggggagcauuggagcucuucccaggccgagguaggaguuuguccaccugcuguuuacuccgaaacuucuugcuccaccugucacuuuagaagacccugaucugccggaaggucuccccguauacccagcagcccagaccucucaggaaagagcaggcugucguccugcauuggaggaggaagcuuggggcagguggcagagcaacuucauuuccagaugaaacugggcucccuggccaucagcugccgugcuuggaggggcguucagacaaagagccaaauuuaaauucauguaauguugcuguuuguaacauugaauacuuaagacaucugcucagagucucgcauuauaaaugaauggaaaggauccaggagggcuuuauuggaugggagccgugaagugagcgccguguauuucaaagcaggaucuuaaucagacauuauuuauaucuauaauauuuuacaaauuaaaagcaguagaaauagucacuggaaggaagucagcaagcaggggugaaaaaaaaaaaaaauaaaagaaccugaagccgccaagagaggcucacugaccaucucugggggagggagggugaagaguagcaaauuuaccgucaucagcagguguguaaauguuccauuuacauugaauggcacaugucauaaaguacauaccgcugcacaucccacccucuguuucuguuucaacugcagagccuauuuuucuuucccuuccagcucagcugccuucuccucccugaccucaggucacccaagacucccacuuuauuauuuccuuuuacuuuuaguucauuauucucugugauucaguggaaacauaaaaaaugguuuuuaauuuuaauuaauggcaaacuuagaacagacccauuuaauaaaucuguccucugaacuuaacacgucuccccgccuuguaagggcugccugucauuuuauuagcgcuggagccucccgaccgaagggcugaguaauugacaaaaacugcagguaaggcaagaggcccguaauugauucauaagaucccuuccuccgaucgcauugaagaguuaauuauuuuuccugcaguugggacucagcuguuguuuccccugggauuaaacagcugucagcauuguuaaugacaucaaauucaugcauuaaaauccucucauucccuucccguauaaggugggguugcggaaaucucugccacguccgccuuuaugaaggagugaaauccuaagaaagauaaaggcccuuauuacaaaaccacagaccggagcuuguguugauggaaucucguaaugaguaauuaagccgcuuugcagaaguccgggcugucauccuggcguuuggguacuuauguucccuaguggagacagccggguagacuggggaaggugauaaaagggagaaaaauagaacuguucuagaacgaucuccacuuuuaacagcacaauacagagaacagagcuacucaauaauuagccaaccaaguaugaauucucauauguucuuaaaguaucugcugauuucuucaaacaucucuaacaacaugucugaugaauacgaagccucccuuuauuuauuuauuuucuuuuugcuuucuuuuuuugggggcagggggcacaguuuuucuuucugucucagucucucaaacuguaggaggaccaacuucaggguuuuauuuuguuugcuuugcuuugccuugucugguuuuucaaagugcucuuuuaacaaaugaaaguuuaaagcuugaguucaauuugaguaauuuguucccagagaaaaaguaaaugaaaaguauuucuggguauuuuuaaugacacaaguuucugugcugauaugcgggcagggguucgggagugggggcaccagggcucaugagccgagagccccugcuucccuuggaaaacggaaauuucuaucuccaacuagggaaaaauuugcauguguagaauuuugguuuuuucuucggcguguuuauuuaauuuaacauuaccuauccuacgauuauuucaaggugauuuuauuacuagucagcuuucuuuucccuagcacaaaacucaugcaacauuuauguugaauguuuaaaauucuuuucuaaaugguuucaccuuucugaaaaaaucuugcauucaaaaaguguaaaggacucuccucauuucugcgcuugaaagugcagugugauuucacaaaucaaacaauaucaggaaaauucaaucucguuaauacuuuuggagggaaaagaaggcaagcguacucuucagagaacggauucuuuuggauuuguguuagagaaaaacugucucuaaugaccgcacagcacaaagcaaagcaguuaaaugaauaaccgccuuccaguacagauaauaaagcaggggaauuuugugugucacaucaauaaacaucuuaauugaacaguacguggguucuucccuaguaccugccuugcuauacacuagccuuggaaagagucuugguaaauuguucagccucaaguuccacaacaaaaugggauucuguuuucuagaaccuggccuaguuaugaugugaugaauccgucucuguuaagguuaucaacuuuaauaaaccauguauuauuuccuuaaauauugugcaaugugcagggaauuauuucaguuuuguuuuuuauuuagcacaaaccuaaauauuacacguagcaaaugucacccgaugcaacugucuguccugaagaggaggacagauuauucuguggcuaccuaaugguguuuacagaguugccacuuugccaaaccccaagacccacacuuggucucugguguuggguccgccagcucuccacccuucagaaugggauguuuagggcguaaucuucugagacccacaaccuaagccgggaagcagaggcaauuuauuaccccagcuuccuguccacuggaggcccggggagaccuugaaaugcucagcugcaagucaggguccaccgaugcagccucggaauuuaaugaggccucuccggacccaaagggagauggacauuucuaggcuuguggaagggacuccccagccccucuucucuccuggugagaccguuguuggaugugaaaaggccuucacuauugucaaggcugggccccugcuuuugccuuguuacucugcauuuuaacucuggaccagaauugauugccaccaauaaaagauacuccaguccuuaaaaagucaacauuguuauguuuuacuuaguuaugacuuagugaacaccuauacgaauuagccucaucugguucaaggguucucagaugggaccacuuuugcacccagggaagguguggcaaugucuagagacauuuuugauugucauaacuuaggaugagguaauagugugcuccugauuucuggggguagaggccggggauagugguuaacauccuacaugaacagggcagacccuugcaacaaaaucuuacgugguccuggaugaaaauaacacuggagguaagaaaccuuggccuagaggguuccccaaccuuuuuuuuuuuuucauuauggcccccucccccaggagccuuuugagauacgacuuuccuaauggucuuugcccaugaaaucugaauaccacagaugugcugaaugccuguucauguaccauauacacaugguauaugccucguaaaugaaagggugaacaguguuuauuccccaacugucgucccucaaaaccaauguuaacaccccuggauguauugucaccccuguugggaauacaccgcucagagaaggguuuuguccauaggcaacacagagccaauugaggccuuugggcaagcggaggucaugauggaauucagccuuucagacaauucugccaggcccuuggagggugggaggaaacaggcaagaccucuggcuccuagaaccguaaggacccuugccauuaggaccaaaccucuuccagcuuucucagcagccacaugucacccccucuuccacccuuugcccugccacccuccauccccugauacccuccugccuuuuaguugccggugcuuggaaaccuuugcaaagucuuuuuauggagaugccauguccuuucaauggugcguuuagccagcgccccgcucugggcuccagcaacauuagggcauuguuauuccauccgaaugacaauuucaagcucacgucuuuguuguccauccucgaauauccugcaccguuccuggcacagaguaggcacuggauaauuauuucuuggaugaaagaaugaacaaaugaaugaaugaaugaaaguuuuuuuccuugcaaaucucccugcacacuuuaaucuuaccagcaucuugugaaacacuccuacuucuuucugaucuuuauuucuuacguaguuuugaaaugagaaccgaugaagcugcuuuugcucaugguaccucagguccucgcucacucccagcacucagggcuguguggucagagucucagauucggagcaugugaugugcgugggccugugacuaacagccacauggcacgcaaugguggcagccugggaggcugacugagcaaguaauuucugcuuaagcaagaacgugaggggugauguaguugcaugcacuuugccaucauagcuugaucuaggucucagccugggaucuugcagcugcgaaaagcauggcguugcguuuccaagccugaacauccacacccgcgaagauaagaccaucucuuggauuaaugugacgcugaaauaaaauaauccaaagagaaaaugccugagacccaccaggagcucaccagauacuacuucuaucuuccccacucuaggucuuuuuacugcaacuaccguuuaaaauacuuuuuccaugaggcagaucuuagugcugacagugucagugucuuuaaugccugguucaguugcaaacauggagggcagagguuugauagcauccaaaguaugcacgccgcacuccaccucccaugcccuuuucuuuuucucagggccaucagaaaggaaguaacuggcuuagauuugacaccucuuuuuuuguucguuuuauguuuuugaaucuagcauguauaagcucaucagagagcuuuccccuggccugggacaaucagguuucaacugaggcucacgcacacgucaacacaggaaccuuuuugaugccuccaggcaauuuccuacaagcucuaauaucuuccucuuuacucccauaugugguaucucugguacccuauauaucauucacucaaguguuuguuuugaaccacuuauuuuggcaagacuucuucagacaggagagcccugagagcucuucaaaggcugggccugaugguguuugucagagagguucgagcucuuaaauuuaaauggccucccacagggaagcagaaguccuuuuggauccuccagaggccugagauccuccagauccuguucauuugccuuauucguuaugaccauagaaguuugugggguggcacucuuuauucuguccucgccccacaagcaaagcacacaccagaagcuauaaggagaugagcucaguaggccuguccuuuacuuuauuuucccuauuagaaucccaccauagacgcccucucugcauguguccuugucugggggagucgcuuaauuuccuuuuucuuugaggggcuauaaaauuuuuguuguuacaaaaaugaaaggggagaggagauagaagaaggaaaacagugaaagcucagccucgaaagaagugcuuaaaggaaaggagguucugacagagggcucggaucaucagcaggggcagggggugcagggggugccugcaagucugugaccguccugaaggacccccuuccuaggaucccaaacaugcacucccaucccagccucacaccaagcucccaucugggaagcagcagacacacauaaaagcaaggaaacuucaaggacgcuuuuuguuuuccccuacuuuuaaaaaauugaggugaaauucacauaauauaagauuaaccauuucaaaguagacaguucaauagcaguacauucacaaugguguguaaauaccgcaucuauuuccaaaauauuuguaucuccccacaauaaaagucuguaccaauuaagcagcuacuacccauuccucuucccuaccauucuaccuucugucucaguagguuugcuuauuugggauauuuuauuuaagugggaucauacaauagcaucauguguucaagguugacccacauuguggcauguaucaguacuucauucccuuuuaucacugaauaguauuccacuguauauugauaccacaguugguugacccauucauccauccaugggcauuuggguuauuuccaccuuuuugcucuugugaauccaugcugcugugaauaauugcauaugaguauuuggguuccuguuuuuaauuauguuggguauauaccuaggaguggaagugcugggucacgcaguaauucuuuuuaacuuuuuggggaaauaucaaaccguuuuccacaguggcugcaccauguugcauucccaccagcgaagugcagggguuccaguuucucacacugucaccaacucugucagucuauucuggcacugcuauaaagaaaugccugagacuggguaauggcugaagaaaagagguuuaauuggcucaugauucugcaggcugcacaggaagcauagaagcuucugcuacugggggcgccucaggaaacuuauaaucauggcagaagguaaaggggaagcaggcacaucuuacaucgccagagcaggagcaacagagagcgacuggggaggcgcuacacacuuuucaaccaccgaaucgcaugagaacucucucacugggacaacaccaaggagauacugcuaaaucauuuaugaaggguucauccucaugacucagucaccucccaccaggccccaccuccaacacuggggauuacaauucaacaugagauuucggcggggacacagauccaaaccuuaucaccagcgcuuguuauuucuucagguacauuuugaugucccuccccacuuuacucuccccuacaccuugaagcaggugcaaucauuuuaggcuaugaggaccagcaucgaccuucaucagcaucugcucuccuuuacggccaggucuccuucguccucccugcucagaauuucagucuuuuuuuuuuuuuuucccuauacagacacaggaaguauauauuuuccucucgaauaucacuugggucuuaucuuguuuuaugcuacaugcauguggcuucccccguuacaaaaagaauucacauuauuagagaacauuuggaaaacauacagaaguaaaacaagccauccccauucccaccucccagagauaacgccuguguuuuaguucaucuccuucuaaccuuuauaguuuuuuuucuaucauauuaguuaggcauugguuuggcuccaagugaaaacugcuucuguuauuaacaucagcagcagcaacaagaagagagaaguuuaugucugucucggaauacguacgugacaggcucccccaucgaggugcucagauaugguggccacugcaugauuuugcucaggacugaauuagaggcaggugaaaggcccucacucccuggaaucagcuagcgauggcuaaggcuccugugacgguuucuacagagguuccacccagagaggagagucaaaugggaguuucuaccgaugcucuugaaaggaucuuguuacucagaugucucuaagacaaugaucaguacccaucucucagagccuguguagccguccaugcuugaggcaugagaugcugaagauaaagguccccagugguccagguuuuuccuucucagcuuggaaagcagcaggaaaacugcacugcauuuauccaaagggugugauugguaaguguggguagugauauagaauaaaucaacguggcugggugcaguggcucacgucuauaaucccauuacuuugggaggccaagguggguggaucacaaggucaggagauugagaccauccuggcuaacauggugaaaccccaucucuacuaaaaauacaaaaaauuagcuggguguguuggugggcaccuguacuuccagcugcuugggaagcugaggcaggagaaucacuugaacucagaaggccaagguuguaguaagcugagauugcaccacugcacugcagccuuggcaacagagcgagacuccaucucaaaucaaucaaccagucaaugugugcccccuuuuccuccaacucccaccccaaauccuugcugaaucauaccuauccuucaccuuuauaagcaucuaguuuuuaaaucuuugcugugaaguuggcugugugagcuccauuugacagauggaaaaacuaagguaguuugccaaagauggcucuuugccuucaggauuuccaugucuuuauuuugaguaaacacuugcacugcuaauuuuauuccaacaauguccuuggaaugguuuuaguucucuuggcuguaaccaagucuacacgauaccacuugaauugacaacaucacagucaaaccucaauuuucacaauuaauugugccgcaguuaauuaaauugacugccuggcaauccagucucaauuaaaauacuaauaguuuauuuauuuauuuugucuuuuacgaagcguuuucuuuuaccaucucucaggauccuauguagguauccugaugguaagaaugauaauaccaugacugauuauuccauaguugcaggaaccccacauggcauuucaaaucacaaucagaacuuugaccuugaaaggggacccggaucagcuccauucucccaaggagacuuuagcuacuaccuuucuuacuuuuugaauaaguauuuugcagggcuuauuuucaucaucuggaaaggaggaauagauaggguuaucuugaaaguccucucuuggaagggauuaugguucuguaauccuguaggacuggacucaguggguaaauguagaggugaugguaucuccguuuuuauugucuucagaaauguugagaucgagugauauaaagucacaggguuggccccacaguuuaguucuuggcuuauguagaaaucugugcuaagaagcgcuguguugcgucaucauggggcauuuuuguaugucaugcagucauacuuugcagaccccugggagccucauucgaguucuuccuguggagucccaugccuugguguugaaccaguguccuagcugggaggaccguuguacugcagcacuuuccuaaacucugcauguggucuccaugauguccuggcuguguuagcaucagaaauggcuuugcccacaucucccaacucugcccucuuauuaggauuucucugcgcuggcugaugccugagccaucuaaugaucuuuacgggaauaaccaaaaaugcuggguggggggggaaaacgccagcagaucucuuuagggcagaguagggagggacacggacaaugugggcagcuguccaugcagcacguaucacauccaggaugauguuuauaugaagcaucauuuuuuuuuuuuuuuagguggagucuugcucugucauccaggcuggcaugcaguggcacaaucugggcucacugcaaccuccacuuuccggguucaggugauucuccugccucagccucccaaguagcugggaguaaaggcacaugccaccaugcccagcuaauuuuuguauuuuuguuagagaugggguggccaggcuggucuugaacugcugacuucgagugauccaccggccuuggccucacaaagugcugggauuacaggugugagacauugugcccagcuuggagcaucuuaauuuaagcccucuacaucccugcacgguagauacaaccagcuccguuuccaaggacgaggagcaacagagugaggucauuucccugaguuacacugaagauggucuaauuucaaaguccuuccuguguccacuuugccaggugccccccgaaaagcaagaagacuccuucaagcauccugaagauuuggaugcuacaacuguauguccugcuggagagacccucccagaacauugaaggcuccaguguuuugacuggcagaaucucaguuucaacaucugucucuaagggcucuggaccuaugcugggugaaacguguugucuguaggauuuggcccaucugagccucacuggggaugggcuaaacuccgugggguuuguauuccuucuccuucauugcucagaggaaaagaagaaaaaaaauaaaaagaaacgaccccaaacagccucuuucgugcacacacgccuaagaaauaggaacaugaauuugcauuccuuccaacugguguguuuccaaaauacagacaggcaaguuugaaucacuuugacuuugaaagcgugauuuugagcaaucaucuggggaaaaaaauaccuccucuucacuaaauaagucugucaaaaagagucauaguacagcgugccauugccagaauacacgugugugcugguaagcuggccccaaccaauuaaauagugaaaugucgacugcauucaggcccuuccuggucugcagacagacuuguguuaguucauuuucauagugguguguauguaucuuuagacuuuaacugacagauucccacagugaguagaguagggaguuaucaauuacaugguuagcuaggcgcugcuauuguaugcucuauggcuucuugacaggagcaggcagagaaggagggaaggacuaauauuucuggugcaggaggacuguuaauauuuuagaccgggcuccucaaacauguaugcuuauuuagugaggagaaaaugugcauuugaauccugcaaacccucgagaaguuugcauuaauaaauagugauuaccagaauauucucuucuaaaauauauuuuauuuaucaaaugaauacccuucugagccccucuuuauccuuccugugauggcuaaacuaauuucaucaaauuuugauuucuguguggugauguugugaacagugccugaaauaauaaaauuacccugagcagauugcauauaaaacuguuugcaaugggagaagcagucuuuggggcugugguuuccuuuggcugcaguguaauauauuccuuuguuucuuuugugaaguauuuauugugggucuccuguagucugaguuucuuguggaagugggcuuguguuuugcuuuuguagacugacacugagaauagcauccaaacaucuuuuucccaccaaggcaucaaacuccaucguuaggaauuccuucauagaaucaaagaaucagaaagagcugaaacauagaccacggacacucaaauuguuuauccugaaaugaaugggaaaaccuaagcugaagaaaggaagugucuggccaagaagcuggcgggagaguagaaucaggaaccagggccuccucguaucuggucucacgcuucuuccgugguguucuuucuuaaguugagcauugcauucuccuuggauaggauggauauuuuccugggaaggaugauacaugauguauuuauccauaaaacugaacagguguuaugugugccuuuucuaauaggaaagaccaucaugcuaugaaaagagaggaaggggagaagaaaugggguacguuaagaucucagaaugaguuguggggcuaaauguucagccugucucccuuuucuccuugccacaccacuagauuauauuuucuagacucuccugguguuagauuuggccuugugacuuccagccaauggaaucggcugcaggaugaaacuagucuugaucccugaaugacugcguggagcacaucuccuucuggucaauaaggcauuucaggagugagagauaaacuucuauuguguuaaaccccugugacuuugagacauaucuccuacagcagguggaguuagcuuaacuaaugcagaacgauaggacuggugaagcaguccaucuguuaugagagcuauucuuuuuuuuuuuuuuuuuuuuuuugugagauggagucuugcucuguuacccaggcuggagugcaguggcgcagucucagcugacugcaagcucugcaucccagguucacgcuauucuccugccucagccucccgaguagcugggacuacaggcgccugccaccaugcccggcuauuuuuuuuguauuuuuaguagagacaggguuucacugucuuagccaggauggucucgaucuccugaccucgugaucugcccgccuuggccucccaaagugcuggcauuacaggcaugagccaucgcgcccggccagagggcuauucuuugucuuuuauuugcuuugaguccgguauaaccauguggcacauaccccuguacauguuugccaagacugcuauauggcagagcuuggaauucuuaggagcuuuaucagguaauugcaagucccccaccuccaagaaagcacucucuaggucaagaaucagcaaauguuuucuauagaggcccguaaaauuaauauuuuauacuuugugggucauauagucucuguuucaauuacccaacucugcuguuguagugcaaaagcagcuguagacaguaagugaauggauggguguggccgugugccaauaaaacuuuauuuacaaaaacaggcagcaggccagaauuagcccugugggaugacucacaugagcagagaguucuggcaucaacuuuguucggagagauacugacauacuucuacucaaguaagucaauguuucugucucaacugguugauuggaacaacauacaaacugacccuuaggaaccuucuaccaaaaauauccugugaaucuucauacuuuuguaauaccguuuaguuagaaguggucagacuuucuucguccucuuuucgugauuuccucuguggugucuguggaucgauaccggcagcucagguaaggaacgugugcaggggauguaacagaaaggagaaagacgaggaagaagggugcauggagcgugcaggggaagaacugauucuuuuuucaguuaaucggcucaucaagguucugguguugaagucugauuucauuugccauguuaagaggauauggacagauacugggcaaaaggaaaaaaaaaauauuggauccuugcccagcuccaaguguugcugagucccuugcccccuccaccccgcucugucaggagccaagcucuggccgcccaguuuuuggacuuuguaacuguuuccgaacggaucagauuccaucugaauugcagauggcuuuagccccagcagcagaggcugccaugacaucggcaugcgauuucuuccaggacuuaacucuggagagagcuccauuuccuguugaucaugaggguuuuacaggcacaaacgcugucuucugucacucugucacagugcauuaugucagaauagaggaagcaguucagcccguaaaucugugccaccggcacgcaggguguuguguugucuccaaugugccuugucaacaccacagggcuaauagcagugucaggguccccgugccaugaaucacuucacaucucuggcuaguacagaucucucccugucacuaguggaagucgccugcacuacauucagaauaggggccaggcgcgguggcucacgcuguaaucccagaacguugggaggccaaggugggaggaucacuugaagucaggaguuucagaccagccugacaaacauggugaaacccagucucuacuaaaaauacaaaaauuagcugugcauaguggugcaugccuguagucccagcuacucaggaggcugaggcaggagaauugcuugaauccaagagauggagguugcagugagccaaggucgugccacugcacuccagccugggcaaaagagugagacuccaucugaaaaagaaaaaaagaauaggcacagacaauuuaccuggauccucacauugcaaugcugaccacuccggaaggaguguagaaguugcagcucaugccugcauuccaaauggcugccuucugcagucccgucagccaggaucccucucauacaaacaccuugacuggccgagaaaugcagaugcugugucaaaaguucauggcucagagccaacaaugcacugugcugaccuccaauuuuccuugaggaggggcaucccagggucagaauuuuaugcaaugcaagcuuguccacgauggcaugggagcgugugggaaugucaagaugaaccggggcuccgggagacauuuauggagucaggagcacacauacauuccugguucugucagcauuucccuaggcgagaugagucacacauuuauauuuuuacauaugcagcgcgcuugcaauuuuccacuggggaugauagaaaaacuuauugaaaauaguuaaucaguuuuacaaagaugccauagguagaggugcuuccagaccuauaguuuugaaagucaccuagaggauaccagucugacucagagcuuuaugaaggcauauuccuaauauccucccugugcuccacgaagaacaauugguuuggacaugaacugguuuccauuuuuagacuccaggcccacaguauucuaaguagguuggggcugugcugauuguaccacucuuuggauuuuaguggauuuucuuuuuaggauuucauguaaguaaccugugcagagagugaggauaaauaagaacaagaaugacaaaccgauaggcuacuugacaucauuccuuaauuccaggucacuggcggacaucacucauucaucaguacucuguuuuucucccaagaauggaucugacucuugaauucucuuuaauagaguguucugggaggcuguuaccaauugaccaggguugaugcacauguugaaacaucuuugccauuucuugauagcuucagaagagauuuuaaaguacuauuauuuugauguuguuagcuuucaaagauuaauuccacagagauuuuugggcaucuuuuugauaauacacauuaugcuugacuugggaguuucaggaugcgcaagagacuccuuuugacugcaaggacucaguaaaacaaaguauuucaaggucaugcuacaaaaagucccaccaagagcauggucaggagguacagugcacuuacccacacggagcagagagggaucagaggaggcuggcuggggaaaugauccuagggcuuucuuaaaggacacagcgccaugguuauuuaaguacagcuuuuaaggagaacuaacuugccacuuugauagcaguauaggacuccaauauuucucauuuguaauuuucagaagcacacgggaggucuuugaaauuuaaugucucccugcaucacaaaccaaaagacgagucaguuuauaaguaggcugugcuuauuaacucaguccuggcuuuauugauugcuuuagguuccaugaucuuuggcaugugagugguuuugcuuuguuuugacaaugaucuuuuuguaccuuguaucggguagguuggaauguguuugaaaauuuaagaauauuuuccuagcaaaggcaggauuuuucaaguuuguucaugcuggagcuccugccacguauuuuguccuuuuuucuuuuuucuagcaacucucgagaggaugagacaaauggauugugaaacuggaaggaggguuucucauuuuuuaauccauuguuuuagugagaguuuaaagcuuuccuauaaaauauguggguugagaaaaauuggaaaagaccucuucaaggacuuuccucuaugcucccucauguuucaaguggcuuuuuugcaugauggugcauaugucuuuguuucuguacagggcccuccauguucagaggcagaguaacgugaauucauuucgcgcuaaugagaguugcgauaugucggcccaaacucucuguguccuuuucuucuugggcugaugaacuugucaacuuuuaaaaaaugugcucuccaaaaauuuccagcaggacuuucccaccuugcuguuuaaacagugaaucagcccugugggcuuugcugcuuacaacaugauuccggugaaaccacaggucucgucaugucccuucuguauccaugguagucccagugggaaagagguaacaaacccaaauugaguaauuucaagaaauuuuaauaacaaaggggcuauuuuauaaaggggggguggucaagguguagggaaacauaaaagagagcgaauuucuggucuggugcugugggucacgccuguaauaccagcaguuugggaggccgaggcugguggaucaccugaggucaggaguuugagaccagucuggccaacauggugaaaccccgucucuacuaaaaauacaaaaacuuagcugggcauggugacaggcaucuguaaucucagcuccucgggaggcugaggcuggagaaucacuugaacccgggaggcagagguugcagugagccaagaucacgcuauugcacuccagcccaggcaacaagagcaaaacucugucucaaaaaaaauaaaaaaaaaaaaaaaagaaagaaaauuaauuucucagagguaguaauagggguggcugucaccauccuuggccaaggagagggagcagauacuggagacaguugaaggugccaggauggagaagacuccuuggaaggagcuguaaccuuugguugaggaauucagccuaccacugguaauacucccucuccccaggagaggucccagcggaauaaacauccccgccccuucaacucuuugccauuguucaagcccugcuagaaaccagauggcaaaaggaaguuacugauguguucauauuggucaacuuuuucaggcacgaagaccaguacagaaggauggaaagugcauuuggguagggaaaugggagauuccugcauagcugucaaguuaguuucuucccagagagaaagaccgguggcuguagucugugccccacucccagccuguccuuucucagccguggcuugugugcaucccuggggccagcauguugcugcgagccccaaucgaucaguggagaaacgagcucuggugggcagucaggcaaagcagauacacgugcuucuuuucagcuuuguuggaagguuucauuuugcuucaggaacuaggcaggagaauuccugaguuccuguacaaccugaguucucuguuaaaacaaggaggaaguaaucauccugaguucgaugauucagaguaagccauuuaacuuguagagcuuugggacuaacaaugaucccuuuuuggaguccuuaauuacuaaaauuaucagcauauuuagaguucugaagaugcugaacccuuauuguaucuccccaggguuagugaguaauugggaauaguguuccaucuuggaugcccccauccacuaaccaucuuuccucuucgggugguucuaagaauucuaauucaauuagaaggccuucuuuuuaguuugauuaguucaauaucaagagcuaaauacauuagcuuauauauaugucugaugaacucaucuuugcuuccuuggauccccaagauagaauggcccugaugcagucaaaccacccugcagaaucuuaacagcaccacaaauauugcauccaggcauccugcccaugcuggcuugcaggcuggggaucccuguccauagcgcccauggcuccaccaccagucaaagguaguggggccagcaguggacuccugugugguucagcucucaaaaaugugaacugaaagacacagaaaaagacuuguguuuggggauaaauacugagacugagcagucuuguggauucaggaauugggcauccaguugggacccuuugcaagaaggguguuagggagcagagagcaugaguaagccagaagcagagcaggagagagaauggagcaggugugcaaagagggcggugagaugcugagaguaauggggcuggcccaggaggaagugagaggaagcaaagugagacagagguggugugugagcgugugugugugugugugugugugugugugugugugauugagagagagagagacagauggagggaaagagaggcgggggauuccagguacaguggcucaugucuguaauucuagcacuuugggaggccggggcgagcaaauugcuugaacucacgaguucgaggcuagccugggcaacacggcaaagcccucaucucuacaaaaaauacaaaaauuagcugggcuuggugacagacgcuuguagucucagcuacucgggaggcugaagugggaggaucuuuagagcccaggaagucuaggcugcagugagccaugaccuugccacugcacaccagccugggugacagagggagaccuugucucaccaaaaaaaaaaaaaaaagagagagagguugagcucaacugaucagcaucucagauuaagggccuccauuccccccaugcuuuguaauugcugccuguuuuccaugaagccugacugugcauugguucuaagucaugggcucugcaagauccuccuugugccuugagaagggcccuguccgcagccugaggagccucaacuguucucugcacgaccuaguucugggcuagggaauggcugucuagcuucaguggauuuccagaguccggagcuacuaaaggucaacagcuguguuacugcaaacucuguggccugcauucuaucaaugccaaaaugcacaucacacugacaacagcucuuuguuuacaccggggagcccccaaagccccaggguaauuccaucaccacccaaguuguaagaugguagagcgaacaggccagaaugugauaaaguaaaaugaaagaagaaaaaggaggaaggaaaaagagagagggagaagcacauagaggaaagaaggaagaaggaaggaggaaggagggagggagggagacagggaaggaaggaagucuggcaagagggcacagucagaccugccaggaucccucugcugucuuaaucaagcuuugccucagucuuucuggacugaauuugucucuguguucacuuggcauuuuuuaaaaggagacaaaacaggugaugaacacagcaugagugauuuuucccuuaagagagaggugucaugcugagaaagaagaaccgaccuccaggggagcuugucuucagaccaaaacccuggcaaggacagccuguuuggaucuuggucauuuuguuagauuuauaaagugccuuugaacagagcaggacacucuggggacaagucaaagcauggcagccuucagcuucccaaagaagaguuguggagaaggaaaagugaaggaaaguaccuuacuaagucauugauggcacauucagcccuugucaaagucaaagaagaaauuuggagaaauucucaccacugugcuuaggagucacccugaacuauuucuuggaugaaauuaccacccucccacuuuuggcaaugagacagcaagcuuggaauuuggaguccauguuaaauccaggucccagccaggcacaguggcucacgccuguaauuccagcauuuugggaggcugagaugggaggaucacuugagcccaggaguuugaggccagccuggucaacacaaggagacuucaucucuauaaauaauaaaaaaauuaaaaauuagcugggugugguggugcacaccuguagucccagcuacucaggaggcugagaugggaagauggcuugagccugggaauuugaggcuauagugagccaugauugcaccacugcacuccagacugggagacacagcaagaccuugucucaaaaaaaaaaaaaaagccagauucuccaccuaccagugguggggccccuuggguaacuuguuuucacucccucagaaccucaguuuccuuuccuauacaacgcaagccauaagguuaaccccuccucguggugauguuaagaugaaacaggaaggugaggggcuuaacacauuuccguguucccauaagcuuucaggagaucuugguaguuuucaucucgguguucauuaccaucaucacugcuucagacuccuguccauguggggcccuguggucuugcgaucaccuccauaaauguuccuuuguucccgccuaacacaauaccagccacaaaauaauucucaacacauauucauuaguggaugcaggggcgaaaugaaacucaggggguugggaaacucaccugaaggaucuucucccucuccccacuuucaggcucuccuuucacaugcaugcauuaauucguucauucuuggaaucuacacaccugugaugugcuaguuacuaaagauguagcaaugagugaaagguaauccuguccuugaggcauucacagguaaagaagccugcuugggacauugggccgugagcuccaacgaugucacuauucuucuaggcuuuguggaccuuuggucaccccuucuguaagaccaacucccuuaucugccuguacaguguucugcgaaucccggucucuacuaaaaauacaaaaaaaaauuagccaggugugguggugggugccugcaaucccagcuacucuggaggcugaggcaggagaauugcuugaauccgggaggcagagguugcagugaacccagauugcgccucugcacuccagccugggcaaaagagugacacucuaucucaaaaaaacaaaacaaaacaaaaacaauuuggcuccagugagcucauuuuacguuguauguaccaguaugcaaguguuguauggaugugagcgucugcguagguuuuuauuuuucucucucagaaugaaagguuugauucguaccagcuccccaucccuucccaugaucccaucuuaaugucuguuguggaaguuggcccacagaagccucaagccuaaccaacaagaaagaucacuucauaugcauuagcuggaagguagcaagaggaaaucgccugccagggucccugacucccggaggaaaguguccucugagcccuccuugagggacauaaauagccucaaaagucacugaaugcuaaguuggcuuucuccccaaaccuucuaaguaggcagucaggauuuaacgacccgcaaauuuccaauuuuuuaguuuaugaaaaaauauaucuacguauaauuuuugccuccauuagagucucaucuuuaaaaaaaaaauuauucagugacuuccucccucucuuuccaaugaggaaaacuggacuauuuaugcugcauuuuaggcuuuuuuucauauauaauuuuucauauaaaugcacauuuuccccuucuuucggggaggaaauuuaacuuuuguggaaaugugauguguguuuaaauuaccaauuucauaggcaauaugucugauaauugcagagagauacugaguuaacuuguagcaaugaguuucugugacaaagggaaaucaguuuguuugcaguaagccgaggauaacggcgccgaaacuuuacuauuuggggguggggggagguuggggaagggaggcccugaaauugcuuuuuauaauuaaaaagggaaucucagauguuuuauaucuugaauauuuacaauaaaaccuuuaagugcuugucaagaggguaaugugucauuaacuggggacucugccucgccucuccucucggacaugacagugcggcuggauaagagaagaguaauuauaguuaagcagggcugccaggugugauaaaugacuaaucagcacgcaggagccucaguccucaaaggaggacuauuacaguguuaucagcugcgggccuggguguacggagcccggaacagggauggggacaggaccuugcgcugugcggcuuggcaugcugcuccagagugagcccauggcugucucuuaguuuugucaccggcggcuuuauguggcugccacggggggacaggaaacacacaggggcuccagcaaucugccuggugcuaauauuuauauaacacacucgccagacuccauggccugaguccggggguggcuuuucguggugcagcuuggauggcaucggaaccugcaagaagccaagacgccuguucuccacggcggagcccgcuggucggucacuccuguuccuuucguguccguugggugcaggcauuauuuccaguguaugugaccgcuucccccgugggaacaguguggcauuguucccugggcaagccaacagcucagcccuguccuagagaacccuggagcuacgacgaggguacccuggaccccuguccuaaauguucuuugacucugcuuagccacugaggauguuugcauuugauucauuugcuuauuaugaucaagaaacguuaccugucaacauuggauaaaccauccgagggaaauuaaucaaaacccccuucagacaaacugcaucacaucgauucucuccuuauaggccuucuuguuuuguguucucuguguguguuuuuuuuccccuagcgugcugaaggguggcauuggaguaccauuuaaagaauaauuuuuaagaaaugaacaucaggacauagacgucugaauaugaggaagugccucaugugaaaaaggacguaaugugcuuuaaagaaagaagaaggagauaggacgacacuuuugauacaaagguuauuuuuauaauacuugcauuuuuaucgguucacguauuuuaacagggagcccugacugaagucacaaaaauuaugacuccggcaccgagguacuuaucugacaaaugcaaugcgaauggucuuguucuuaucaaugagaucagauuucagaaaugaaugugaagaccgaggcguugcuuugugcacagauaaccuugcaggcgcaaacucccaaaccagaauaaaagaauucucuaugaaauaaugggccaggaagcccaaucgcgucacacuguaauagacagugggggguggaaucaaaagggggaaaaaacucauuucaucucaguuaauggcagggaaacgaaggcagagaaggacuuucuuuggagcggagcugguacgacaaagagcaggguuucgccgugucaugcaccauuugccguugcacuagggcucuuuucaggagcugugaagccauuauuauaaugugaaaaagguggaaagaaauacucccuucuggacacuggaagggcaaaugaggugcaagccuuuuuuuuuucuuucuuuucuucuucuucuucuucuuuuuuuuuuuuuuuuuuuguuuuuccucccagccucucuccuuucccauuaugcacaaugcgcugagaaaggauucccagucccccugguaaaaagucuggaggaugccgaggaguucacugugcccuuagauaauaacaguuugucuuggcucugaucacuccuuuuugugacuuagcuggcugggaaguagcaaaaguaucuuccaagcucagcuucucucugcuugcauucuuuccaaauacgugauuccaaagcccaugcccaauccuugcacugaagcuuuuagcaggaaaggugaacagaggcaucuggaugcaucgcggccagucugccccuugcccaauucccuccccucuccugccuacaggucaucccugagaagugugccuguggacugcguucuuugggguaggacauggaaugggaagaugaaaagaaagccuuccuuuuucuguccucagccguaagaaagaaugguuucuucacagugccgauugguaaaaccaaguucuuuguaaauuauggaacccaagcuggaacuuggagagcauucuucuaacugaagauaaauaugguugccacugucuuuauaaaaaaaaaagaaaaagaaaaagaaagagagaaagagaaaaaacugcaaaaccgcaaacuggcuuguucuuaugugguugauggggacagcaagauuacauauauagccagcauuugauucucaggacugguaaagugugaagaacagcagugacauucuagucuucaauaaaucacuauaaaaauguuuaugaacccugcaauuuacugucuuuuauaugcaaauugaaaggggcaucauugcaaguguaaaggagacccgagguggccugaaggaaguguaaaauguugcaguagguuuuggagauugugugaucuuaaaugggaucauuuccaaacgauuuugcguuuauaccucugugacaguucgauuaauuuauuaaugagauugcuguaaguugcagggaaguagaggccagcuuggaguuaaaggguggcuuugaaugaaauacauuuucauuucacugaaagaagagggaaacuggugauuccaaauccagauccaaaaaguuauuuuggcaaaaugaaaucagaacguggccccuuccaugaaagucagcucaggcguagaauguucuuuuuuuuaauuuuuuuuuuaacgaaacucacaucuucuuuaaauaaaaucuccauuuagaaauuuuugaagacuuguggauagaagaaguaaccuugaaaagggcagagcugagccagaccccuuuucagcugggugcucccuggaagauggaucuugccuuguggauguuuuucuaccgugacagaagauagaaaggaugaaauagaaagagugugagugaauucugcacccacccccgccccccagcuuccccaccuguaaaaugauuugcucaaaguuugcaaagaauggaggcauauucaaagugcucagcacugggccggacccauggguaugcauucauaaugaucagcuucauucucucccuuucccucucucuccacaccuuuccauuccuccuaacuaaugugggagagaagagaaaauuacagugagagaugguggucaguuuacaacaguauuuagaugagaauuaagauuauguccauucagggagacucuagugugcucuacauccccccaaaauguggggacaauauggcaaauauggccagguacagugacagaaaguaaacagcccaugaaaacagguugcucugcaauucucccaacuguucccuucccgcuucccaccugccucguauggaaaacacccaaaguaggcacuguuuauagagccaucgcuugcagaacaucuccccggccuccgacacaugugccauaaaugcugcagagcugcguccacagucccugcuccggagaagagcauuuugcuuguuuucaaacacaagcauccucucccgcgccugggagggcgaggugcggaucuuuucgccuuggcagucccucgcucaaaugugcgucucuggcaaguccugucugcugauaguugauagugcugccacagagcggcugucagauuccaaaggcaucauaccaucugcuuuuccaaucuucugcucuucaauguagacauauguucgagugguucgugugugugccuggugaggggggugcuauuuuccgggggaagaggaggaggagaggaugcuuaacuccaagaguccucaaagcaaacugaaauaaaauuuuaagugaugccaaaauaagcagucccagcaagacauguuauaauauaagguccuuuccuuaaaaccauaccuauaucagcuuuggaaauaacguaccucuuaacugcauggaaaaucuagaagauucguggcuugggucuguuucuauucuuaccacggugacacgcaaaagaauuuuuuaaaaaauagguuuguuguuauuucuguauaucuguaugggccugaccucccuuuucucugggcuuucuacuccagauuuuuauuuuauuuuuacacuuucauugcccuuugcucuuucuggcuuucaccuaaacaauagcauguauauacaacaguaccuauaaaauugacgcucgugucacugaucaugccaagaaaccuaauguauggugaauuugcacuaguauuuauuuccucccucccugucucuccccucuccuccccucccuuccuuucccuccuaccccucuuucuuuguauuauuccccuagaaggaaauauucaagcuggcuuuagagaggauagcaauuguaaggucaaccaaguaugggauggggaccggaauagauuuucucugcagauuucacgcugccuucccgggaauuucugaauguuuugcagccuaauguuuagcuuccaacauucuuucuuuuuuuuuuagacagaguuucacccuuauugccuaggcuggaguacaauggcgcgaucucagcucacagcaaucucugccuccuggguucaagcgauucuccugccucagccucccgaguagcugggauuacaggcaugcgccaccauaccuagcuaauuuuguguuuuuaguaaagacaggguuucucccuguuguucaggguggucuugaacuccugaccucaggugaucccgcccgccucggccucccaaagugcugggauuacaggcaugagccaucgcgcccggccuagccuccaacauucuuuaagaaaacugcaccaugaguaaaauggggacguuuuucucuucugcugggacccaggacauguuggacugcacaucaguucauucucucugaucuaagguguuggcugcucuucucccuucuccacugggcucugagcuucuugagugaagggucuguggguuuucacgcuuuguacucgggcccagagcagagccuacugccuucacagaagaugcuccacauguguuuguagaaggaacuuggaagacagucaguuuuaaagauuuuuucacugagggacuaagagaaauagaaacagaggggauuggccacaccugaagucauucuguguucaaaucuuggcucuaccaccuaugaucugggagcuguuagaggaguuaaucgauguaguuaagacucaauuucuuaguauauacaauagguguaauaguaaaaauuagaugacuuugauguguguagguaagcggcuagcacagugcucagcaugcaugaaggacucuuucauuaucguuauuaacugauguuuuuaacuuauacauugaaagguggaaacaagcguugcuucuauugaaugacuucuugaaagugccagucugauccuugaccuucaggugcaucucuaaauucuuucaugucagggucucugaaaucugaacacaucucaaaguucccuuaugccuggcaggggcgguguccgacuuuguuauugccuaugcauguauaaaugucccaaaugccagcaaccaaacuugcaggauggguguugacagauuccaggaaagucccagauguaacagcggaauauuccaccuucuaggaaccaaauggcugugaaguggagagacaggcagagcuagaaauauuccggacguggaaaucaaaaguagguuugcgcaacacaacugcagagccagcucaagaacccagcgccaguggcugaugcuucuucuuuuuuuuuuuuuuuaauggauucuucuaaggauggcugcaucagccaggggcagcgggucauaccuguaaucccagcacuuugggaggccaaugcaggcggaucaucugaggucgggaguucgagaccagccugaccaacauggagaaaccccgucucuacuaaaaauacaaaauuagccaggcguaguggcacaugccuguaaucccagcuacucgagaggcugaggcaggagaaucgcuucaacccagaaggcggaaguugcggugagccgagauugcaccauugcacuccagccugggcagcaggagcgaaacuccuucucaagaaagaaggaauagcugcaucacuuaugcucuugaugguacagaaaaugaucugcauggaggaaaucuagacaucagcgauucagagucaaaauguuauucaggggagagagacccuucaugugaagaaauuuuaggaauacuuuaauuauuuuuucacuuacauuuuauaguauuuauuguaugcaccagagugauuggugauaaaaauggaggccuacuuaagucuaagagaguucuugugaaagugggagggggaugaggguuggaaaauugccuguuaggugccauguucacuauucagaugauggauacacuaaaagugcagacuucaccacuacgccauauaugcguguaagaaauuggcacuuguacccuugaaauacauaaaacuuuauaaaaaauuaaaaagaguuacuguaaugauuauaaaaugaaaauucuacgucaugagaaagcauugugccauauuuucaccgggagcauuuuuuuuuccuuaggggaaaugaaaaauaauggcaucuaugaucuuagauuuaguaaaacgcaguaucuucuuccccagcugaaauagcgaaagggucucuucaggcuccugggauaaaaaccaggauccuucaugugucugagcaggcuucccaccauuugacugcugcuccuuuguccagacacauuuaacaccaucucccugcaccccuucacugggcuccgaagcugcguucacacggcacgucauuggcagcucaucucagaagguuccagcuuugccuggcaaauucuccuccuuccuuuagaucccaucucugguagacagaguaaugagccccgaagauguccaggcccuacuccuaauuccauggaaccuauaaauaugggagguuacauggcagauggggaauuaagguugcagauggaguuaagguugcuauucacucaucuucagauugaaagaucauccuggauuaucuggguaggcccagucgaaucagagauggggaaaagagaggcagaugggucauaaucagagagguggcugaguaaagaggacuuggccugauguuaccagcuuuaaagagggaggaagcguccaggagccaaggaauucaggcagcgucuagaagccagaagaggcaaggaaagagauucucucccagaacuuccagaaaggcacgaagcccugcugaccuuugauuuuagcacagugauacccauuguggccuucugaccuucagaaaauaaauuuguuuuaagccacuaauuuggggguaauuuguuacagcagccagaggaagcuaaggcacccuauaauauacccucuaaaagccccuuucuugggaaguucuccagccuuccccauugacucucagaggacccuggaccucucuuccauggcauugccaugguuugucauguugcacuuauuugugugaugauuuaauuaauacucaucugccccacuggacgugggcaggaauagugugugguucaacuaugagauuccuagggccuaccaccgccugggguccaagaagagcucagcgaguauuugcagagugagugaaugcaggaaggagucaauaaauacauuaauuaauuaaucugcaggagaaagaagggcaagguacuaugaacuuuaauuaaacacauaucccacauccaggugccagucagggagcugcgauuuaauuugcugcugaaugcacuuuugaauaaagggccuagaagaugcagucucgaggaacggaggccgguuagagacaggcuggcagcuuugccuccucucccaagacaaaggccuccccgccccccuaaauccagcacacaaucagcugcucucccucccccuauucucagcaggagagucaggaugcauauuucuuuaagggaugcuguugaguuucuucugguggagcgaaggauuuguagcaaaacccagcauguaacucgaguguucugugaagccagauauuggugccaagcuaaauuugugcgugcagcuucuguuuaaggcaauuauauaguguguaauacccaguagagaaauuaagucgaaguacauuuugcccauagagauuauccucucaguuggauuuauuuuaaacaaguuuugccccuuauacauuaaggugcaugcaauaaaucacuuauguaauaaacuacucuauauuaugugggaaaaaaaaaaggagcugguggcagggggagagauuucaaauugagcuagaccucaggcaugaagggaggggagagagggggaaauguggaggaagggggcguuugugcagugggaaguuggagaaaguacaaaugaaagccucucugcagugaaccucaugacugcuuuagagaggugcuuauguaauaacugcaguggugucgcuuuagaaaaaguuacagagcuugucuuucuagagcaaccucuuggcuuaucuuaauuaccagcaguccauagugagacuggagggaagaaaaaaagauguaagcuuuuauuaaauagaagaaaaucaggggcagaggacagagggugugauuaggggucugggguaaccacaaaucugggcaacuggaauuuauuguaaugguaaauuacacuaauaauaaucuggggaugaaaacagggcaggcagugaaaccugaaucucagcuggacgaugaaugaguuuuaaugcaaguguaucgacgugcuguacuccuaacacauuauuuguuaucugaaauuuagauuuccuuggguguccugccuuuuuuuuuuuuuuuuuuuuuuuuuuugagauggaguuucacucuucuugcccaggcuggagugcaauggcgugaucucagcucacugcagccuccaccuuccaaguucaagugauucuccugccucagccuccugaguagcugggauaacaggugcacaccaccaugcccggcuaguuuuuguauuuuuaguagagacaggguuuugacauguugccaggcugcucucgaacuccugaccucaggugauccaccugccuuggccucccaaagugcugggauuacaggugugagccaccgcacccggccccugccuuuuuauuuugcuaaaccugaugacccuugccauagcagaacuaaagugaugaugaugauuacagcagaucaguuauuuugagcucugacuuugcaugaggcccuuuauuaagugcuucacuugugugaucugauuuaaucuucacaagcaaacugggacagagggacugugccuauucccauuucacagaggugaaaacugacacuuaguuuucacccggguucucccugucuauaaggggaaaagacaggguucacaccaaggccugucuggauccaaaacccaugcucauaaucacuaaguuauacuaccucuucgagaugcugauuuggaaaauaacuccaugaugaaacaugucaagggagacugccuguacuccguaaugcagaaaugcauuagagcucaaaaaucuaugcuguuuaggaaagaaaaaugauaucgcucagaaaaucauuuaaaaacuuccuggugaaugcacccagcucgccaaugcaugccagccacagggccucacagcacauuucaggagcaagacaauucagaccccacucuucccccugaaaaaccuccuuccagaacccucuuuugcagugagcagagauaagccucuccaauuuacauguuugucauucucuaacuuugagagcccaauaaaacuaagugcuuagugagaaucagacauggauaagcugcuuguaauuuaugauuuaaugcagcauaguauaaaaauaggcaaugaaacugaaaggcaaucaaagucuauugucacaaggaaugggaggaacggggacgugaucuaacauuugcugagauccugcuguauaccgggaacagaacauauaugguuucauuucauccucccauuaucaccgugaggccucuuccgcuuaucuauugcugaguaacaagguguaccccucaauuuacuggcguaaaacgacaacaguuuuauuacaucucaugauuuucugggucaggacucuggauaggguuuggcugguugagucuccucuugcaguggcuguugauggaggucauuuaguggaauccaguuggcaggagagcuggccuuggagagucuaggauggcuuuugucacauguccagggcuuugucagguuagcagggcagggagggcucagcuggucucagcucguggcugcuccagcaccguggucucagggugauuggauucuuguagggcagcuguuucagcuacacagcagaaguggcacggccuuuucugacuuagucucagaaggcagagggugucacuuccacugcaucuuuggggaaggcagucaccacuguauaguccugagcucacugggauuaaggggaagggacacagacuccaccucucgaugagaggagaagcgaauugaugggcagauuuuaucacuguccuggggccuuugcucuuugcccuucccuuugccaagaaaguucccuguacucugcaaugcugaguacuucucauccuucaggucuacugcaagugucacuuggccaacacaccaugccuucccagucucugguguuacugucugcauacuguagaccaucaucuuguuugcauacuugucuguuaucucuuuaucauccgucuacccacaucaggcaauuccaagagagaagaccacugguuuuguuugaucuagucccuguugagucccugugcaccuucagaaccacaucuagcaauagaaggcgcugcacggggaauucuggaaugaauaaaaacgcuuggcaguaccgcauggcgagccaguacccgugaaugcuacuuccuccaaagagaauuccugggauaacagagaauccauucauggcugccaggaggacuuggauauuucucauuuuccauuggcccuggaguggaggaacagagccgaaaaguacguggggggcaggcaaagcugcggucagaggcagacccuguugguguuggccgugucaaccagcuuugcugguuucuauuauagcccugguguggcaaaggacacugugugacugugagcucaggucagcauugcgaucccuucaggccucuggcuugcagguuccuguucaacccucuuaaauaugcuuuugaagcccguacguucgguccacgccaacuccuguuuauacuggugcgaagugaugccugcucagauucugggcguuucacgggaagguauuaaauguguuuugaaaauacuugaaaguccagcuguguaugcuuuauuuuauauuuagccuuaaauuagagacuccauauaccucaaguaauaaaaaggcacagcaggcacuuggguuuucccucagcuugcuggggccgugcaccuaugugagauuuuauuauuuguaauuuuggggggguuaauuucacagcuuaauucuggccuuuaugcauuuagagcuccccucuuguguuucagaaaggaggaguuguuguuuucuuuucacuugaguuuaauaaaugaaaaaggggaagggagagggaaggaagaggaaaaagcacaaaugugcuuguuuuuggaucagccccuguacugggcacauggaugcagucaguccucaguguaccccaggaaagaggaaacugagucuccauguggcuuucugucuggccuuucucuuuugcuugccuugugcuuugaaugcaggccugauguuugccuguggaccucaggauuuguaaggccaucuccacccaccuacagcuaaguuucccaagagccgaucuccagccaaaguccaagguuccuugaugaccccugggaggagaugcaacacacaguuuccuagaaucauuuacuccccaggcuaagcacagucacagaaaugagguagcuguagccaaggaugauggcauagcacauucguuucuuaggcgugccacguacuagguggcuucagucagcagaacuguauuuucccacaguuuuggaggcucaaauuugcaagucgagguuucggcaaggccauccucucucugaaaacucuaugggggcguccucuuugccucuucccggccuguagguauuuccuggcaaccuuugguguuuggggcauguugucaccucauugccaucucugccucugucuucucaccaccaucuuccuuguccaugucucucuaugucuucaauguucuucuuauaaggacaccaguccuuggauuuagagcccacccuaauucacuguaaucacaucuuaccuaaguccaucugcaaagacccuauuuccaaauaaggucacauucugaggcccuggguggacaugcauuuuagggacccuuucaggccaccauauauggauuccagagugaccaguagaacauagcucaggccaagagagaaacucaaccuuggugaaguugcaugagaacagaaggcagcccuggucccugggagaaacccauccauacucugguuacccacuggccauuccuggggacaggcggcagguguuuaguccccucucugcaaccauuugcggucaccucuuaugugcuaggccuggugcucagcgcugagugaacccauaucaacaaggcauggucacugcgcuagggaagucccugguccaguggggugaggguggcaguggcuggcaacaaagacaaugagcgcugagauugaacuacagaaagcagaagauggggugacaaguuuggccugcggcaggaaagacuucccagucuuuaaggauaaguggcauuugaugaguugcacaaagaggagaccuguccugggaauggaggagaagaugugaagcgcgggaaguccagggacacacagccgugcagagacccgggggccucagcagguuagagugucugcauggcaccggcagaggaugaagacagggcuggggaggggcaugggguuagccuaacaagggcaucaggugccagguuagaguuucgguuucuaagcuguagauaacaaaaauuucuugaaugcuuuuagccccugaucugaguuacgcuuuuuuuuuuuccuuccauuuuccauccaacagacauuugugaggcacuguauuuguuuucaauugcugcuguaaccaaugauuacaaauguaccgucuuaaaaaccuaaauguauuaucugacagucccauaaggcaggaguccaacacaggucucacucggcuaagauccagguguagguggggcugggcuuuuucuggaggcccuagagggcagcuuguacccuugcgucuuccguuucuuagagguugcccaucuucauggacucagggucccuuuccuccaucuucaaagccaacagcaccuggcugagucuuucucaugcuggcauccuucuggcucucucuucagauucccucuuccgcuuuaaggaccuuugugauaguuuugcacccacuggaugacccagaaucaucuuccucuuuuaagaucagcugauuagcaacgucaguuccacccacaaucuucauuucccuuugucgcguaaccuaacauauucacagguucuggugagugggauggggguaucucuaggggaccauuauccagccuuccacaggcacuuugucacaggccaggcgcuaugccaagcagagaggucacaauagcaaaugacacagacaagauccuugcacuuccaaaacuuauguuccagugagggugaagggcguugaagaagucaacgagaaagucaaguuuuuacaguaaguguaaguugugugggugaaauaaaaaagguucuuugcuggagaauaacaaagggagggacuuacauaaauagaguaaucaggggagggccccugagaaacucuaaaacaugaggaaagggcucaugaugugaagaacuggaaagguguuccaggcaaaaggaauggcaaacacaguggcccugagacacucagagaaaucacucaggcugccuucgaaaggauguauuggagaagaugaggccaggggauuguuaguaacuguugcaaggauccgggagaaagaugaugaaggccuuguagggcaagcuggauaagagcacccaaaauauccauaaccgaauccccacuacauaggcaugcuacuuuauauggcaaaagggaauuugcagaagcuaagcacuuuaaaauuauuaucuccuuaaaccucacugcagaguuauaaggaaagcacuguuaucagaugaagaaguagauuucaucaagugacucacccgguaucauauagcugcuuagcggcaaaaccaggaugugaauggagagcucuuucucggauaccaaagcuauuuaauauuuaucauugacuaauaaugguagagaaaguaaucaucauaaccucugcccuuuauuagucacucauggugucacaagcccuuuacaaagcacugugcaugcaaaugauuccucauaacaaccuugggagguaguuacuuucauuguguuagcuaucucuugcuguguaagaaauuaccacaaauuuaguauauuuguuaucucauagcuccauagguuaaaaguccugguucaggcugggacuucugcucagggucucaugaggcugaaaucaaagcgucagccagggauggggucuuaucagaggcccuugguuauuaacagaauucauuuucuuguaacuguaggacugaggugcuuguuuucuugcuggcuguugacugagggccccuugcagccccuagaggcuauucucaggcucucaggcccuauccacagaugaccucacaacaugacuguuggcuucuucaagacugaaggaggcucccccaugcucugagucacucucuucagugagggcccagccccuuuuaagggccuagcgauuagaucagucccacuuaggauugaaucccuuuugauuaaugcaaaaccaacugcguucaggccuccaugacaucugcgaaauuccucccccuuugcuugguagccuaacucacucaggggggcaaauuaucccaucauauucacaguugccgcccacacucaagagaggggauucuauaggaaauggaagucuugggggccaucuugaauccugacuaccauagucugugaaauccccauuucacagauguugaaacugagacuuagaagcauuaugcaccaugccaaaggccauggaaggacagagcuugggcaugcucccgacaccaggucauacugaugucacucucccuacucccuucacucccuccagcaccuggccuucaccugaaggugcugaccuugcuguuuguugguuucagcaaacaaagggagaucacagcaccugucccaggccuugucuuccagccccacaaacgugcaccugcagccggagaccagggggccccgaucagguggcagggccuuuaauuggagccacguguguauaaugagcagcgcacacacacaaaggcgagcuaaaaaugucuccacccuucuaaauaugggaugccuuggccagguauugagucagcucugugacgccagugcaauuaucccgauucagcaucagauuuauucaccauuaaacauguucuaacuugauugcaaacaagccuuguauuauuuagagggauccacggagcuggcagagggggcagagguguccgcaggccuccugcccuuccaggcuuaauggaugaucaucuucccugcuaaaaaggcccauucacuaggugagugauguggaacuguuuaaugaaagcaggaagaugaugugaaugccaguucacuugaguguuacaaacgguuugggcacuauagccuuaaaguuucuccugcucuuugcagaugaaugaaggggcgcuuucuggaaucuuuguggcuggggcugcugcucugcacugcuguggcucuuuuucacaaaugcuuauggagcucuaacugggggcaaggaacugugcuacgguugggaagagaggagugggcaaaaggagacacuggggcuucugugacuuuagaggcccaucaucaaauuuucuuuuuuuuuuuuagauggacuuucgcugugucaccuaggcuggaguguaguggugcgaucucggcucacaguaaccucugccuccuggguucaagcgauucuccugccucagcccauaggcacaugccaccacaccugacuaauguuuguauuuuugguaaagacaagguuuccccauguuggccagccuugucuugaacuccugaccucaggugauccacccaccucagcuucccaaagugcugggauuacaggugugagccaccgcuccuggcacccaucaaauuuucaaaggaagaaauggaauggugcaaccaugguacaugggaaggaggagggggacacacaagacuguaccuaucaugggggcuucgaccucaucugggaaggugguuggagagagugaguccugaccugagcuuuggaacuuaucaaguugagagagaaauuugauaauuugucuauuaacgugugaccuugggcaagucauugaccuucucugaaccucaguauccuaggacuucagaagcgaaaggaagaauaaugggucuugaguaugccuagaauugagcaagcugcuaugcuugcaaaggccuuggccagcugcucacccaccaugucccucuguucccacuccaccuuacucaugccuagacuucuugcuuuuuaaaaauaauccacccaugaaacaaguguuuauuuacaaggcuggcuuccccaggaggcuuucacaaaugcuuaccgagcaucugcugugugccagacaagagugaggagcuggggacucagagaggagcagacgagggagacacucacauuagagaguggcgugugcugagggaaggugccucaggcgacagaugggaccagggccuuuaacucaguggcagcuucagagacagaucuggaaccccaggacucaaaggaccuauguuugcuaaucaagugaacacggaggaccugccacugggcagggcaucccugaccaauccacaggugauggcgggacagcuccaggcccuggggaucccccagggaauaagccagauuaaagccccugcccugugagguguggcaaagaaacagacaauucaugaaauaaauauaugauaaauaacauaugagaaggcagggagugguaugaaacaaaucagggaaggaggagacggagaaguuggagaagacaguggauuguuucucuggguggucaaggaaggcuuccaggcagaggagguuuggccauggguaccaagggguagagaugggaaccuuccagggacauggacccgaugcugccagcagaggggaaaccauggcccuaagggcagagcacacuggggcggggguggggguucagugacagucugguggccuguguggugaggagugcgggagaugggaacagagagcgagagggcagacggggucauguugugugggaccucggagguccugccauggcuuugguuucuacuuggagagaaauagggagguuugggcaggcucugaguagaggaguagcacgaucuggcuuacgaugauuucuaacaucucaccaucuuuacuucuguauauaaauauaugauaaguauaccuuuauauaugugacauguaucuuuacauaugauauguaugguuacauaucuacucacucacacauccacacacacacacacacacacacacacacacacacacacuuuuuuggaaccauugaaaaguugcagacaucaucacggcucacccugaaauuccuuagcaggcaucuucugagaauaaggacauucuucuaugcaaccauuucacauccacacuaagaaaauuaacacuauuacguaguauuaucuaauaugcccucuacauucaaauuuucaugucuccaauccugcccccuuuggaacuucuguugguguucgaucuggaaucugagaauucccuugcauuugguuuucaucccccauagucuuccuuuuuuuauuuuuuauuuuauuuauuuauuuauuuauuuauuuauuuauuuauuuauuuauuuuuugagacagggucuuaaucugucccccaggcuggagugcagugacauggugauggcucaccacagccucagccucccugggcucagucgauccucccacuucagccucccaaguaacugggacuacugugaugugccaccauagccagcuauuuuuuuugcauuuuuuagagaugaguuuuugccguguugccgaggcuggucucaaacuccugggcucaagcuauucaccugcuuuggccucccaaagugcugggauuacaggcaugagccaccaugcccggcccccuuuuuuaaaaaacaaaaaaacaaaaaacucuuuuguguuuuagaaauggggucucacuauguucuucaggcuagucuugaacucauggccuccagugauccucccgccucagccuccugagucacuggaauuucaggcaugagccacugugccuggccucugucaacuuccuuaucuagaacuaucuuuuuccucuauuguuuugucccucacuucugaauaguucagggaucccucuggcuacuguguugagaauaaagugucaaagccaacaguggaagcguggacacuggguaggaggcuuuugcagugcucucggcccgcgcuguccaauagaacuuucugcagugauggaugucuucuaucucugcccuguccaguauaaaagccacaagccacaucuggcuguguggcacuuggcaugcaacuaguaugacaucuuaauuuuucuuuuugagauggagccucgcucugucaccuaggcuagagugcaguggugcaaucucgacucacugcaaccuacacuuccuggauucaaguaauucuccuaccucagccucccgaguagcugagauuacaggugucugccaccacgcccagcuaauuuuugcauuuuuaguagagaugggguuucaccacauuggccaggcuggucucgaacuccugaccucaaaagugauuugcccaccuuagccuccuaaaguacugggauuacagacaagagccacugcgcagacggacauaugaauuuuuaauuugauaucauugugaucaauuugaagauccacauauggcugagggcuacucuaaugaguggugcagcuccaaggcagagagauggcugugauuaaccaaugaaugagggaacaaauauccaggcagaaugaauagucuauggaaagggcuggaaguuccacaaagcaggacguauacgugcccuuuuuuccuccccugguggccagccagccccugaaacacagcagguauucggugcagccuucuguuuucuuccagauccuuugacuccugccccaccaacauggcccguggcagacugggcugcuguuuguaagccuggcugaagaaaggcaucacaaagaaaaugccaccagcaggcugggugugguggcucaugccuguauucccagcccuuugggaggccgaggcggguggaucgccugaggucaggaagaaccugggagauuggagguugcagugagcugagaucgugccacugcaugucagccugagcaacagagcaagacuccguuucacaaaaaaaggaaaugcuaccagugagcaggaaguuggugguccuccagaauugcccuguugaggguaucucccugcccuggucugaaagcugccacuugccgcccaccgcacagccccagggcuuuagcucacugugcaggaagaggccuuccucugugcauccucccacagggucgagagugaaugccuugccuuuaaaaauaaaaugcauacgccuguccucaugcgcucugaucugccagcaggcugugcuggggaguggugaguaguacagggaugugucugaccccaggagaacugccccgaucccuaucuugucucugcucaguucugguaacucuuuuaucuucccuggaguuauuuuuuucccuucuuuguuucucuuuuucugugugcucuucuaagaguaaaacgcauguccccccaugaagucacucaaagcucaggcgugugcaacagggacagcaaaagcacacacaaugauggccagagacacugcucaguguacugucuuccaccgggacagcccacucaccaaggguuagguccugugcugccugggucccgggucuccucggaggucgguuugcaucacguggauacacuaaucuacccaaguugacuuggagaaccaaucugaaaucagaugggagcucccggaagcaaagcaauugcagguucauuuguuacuuuuauugucucauuucuucuuauuuuuuuagcccaauugccuccuacauggggaagguugggguccucuuuauucuacuuuucauucucgcucugccgcccucccagguguuuguaaucacauauuuuucauuugguuuccggguccagcgacaagaacaccagaaacaccuccuccccagagaggaagagaggaugcuccgccgccuguaaggauuuuuugcucuccuccuuuugucaguuggcaugcgauaugcuucucaggcaguaauuuagagacugucaauuccugagagccgcuggggaacugagcaaucgucugcauuucgucgcuuuagcccgagcugggucuuugagcuggcagagaccaagaucuuuuucugggaagggaugguccuauuuaaggaaggcccuggauuuugucaaguuugaaagguuuucaacaucuucccgagaugguggucaugggaguagugguuagggugguuaugacgcaugggacgggagaauaccaugcccacccggugauuuauaccaaaagaugcuuuccuggggugguucugcuggcagucgggcagugacauguuauuaauguuuuccuguuuucuauuguccccgaauggaaaaacacuguggaaccuuuaaauuuucucaagcugucuauguuuuccuggaucgucccucaauuuuccgugguaugaaaaauguaaauguugcuacauucaguucagggaaauccagccguugcuccagauccuucuaagauuuuucaauuccagagauguuuucaccuggaagauuccccagauuuggcaaaaacaacccaacuccuagccacugcuuuuugagcagcuacucagugccuaagacuuugaauaguuuauuaaucaugugucacugcagcaaaggggacauuucggcccugauuucagagaugaaagaaccaaggcauagaaauugagucacuuucuggaguguacacaacuaguaaguggauucgaguuaguuuugcucuauuccaaggcuacuuacuaugcuauuuuugguuuccuacuuuuguucaacuuauauuuaucugauuaucugauucucuuuuacaagcacuuagugagcaucagcuguuucaaugagcauuuauuuacugauaccugugguggcacccaggaaggacuaggaaugcucugugauauguaggagaaggauguauccacugggcaaagguaccugcgagggaucaaagauggaaaggcagaaauccaaggacuacgugugacaugaaaggggccuuucuccugcugucauccugaaccucugucuuucaaauuuggaugugucgggggccacaggacacuacugugcauuugccugugauuugccauuggguuggaguacuucuccugaguuucugcaguguucuagguauggucuuaggcccuggaauaagacaguguaggaaacacagaaggugccugauuuccugggccuagcuaaggggaaaaagcgagacaauggggucagaggaagcucagcugaacagaugaaguugagaugaacagaauuccagugccaccaugauuuccagccgugugaccuuccacaugcuuuuugauuuuucuugaacucacuuuuccuuuguuugcaaaauaguaacaauauuuuccuuccaagugauggugaggauuuaagaguuaaccugagugucugcugcauaguaggugcucaauaaacuauaacgucuuuauuucuuuuccuuccaaugagaagucacuuccuggagggaagccaccuccaggaacaguccugguucaacucaugaggagggucacugguuggguuccauauucauaucugcaaccagaguuggaagcacaccacugugggauuagucaugucccuagucccugucuccguauauuuucuccuucucuuauuaguuuaucuuuuccaaaaugggcuguuucgucucugauccugauuuauuuuuauuuuaauuaaauaauuuauuuuucugagacagacugucgcucugucgccaagguggagugcagcggugugaucuuggcucacugcaacccccgccucccggguucaugugauuguccugccucagacucccgaguagcugguacuaaggcaugugccaccacucacagcuaauuuuaguauuuuuaguagagacaggauuucgccauguuggccaggaugaucuugauuucuugaccucgugaucugcccgccucagccucccagagcgcugggauuacagacguaagucaccacgccuggccugauccugacuuaguuacgguuaccucucuuuguaucucuauauguucucaaauuccaaccugucuuuguaauccucuauuuaagcuaucgauuaccuccaaaaggcccugaauguuucagaaagaaaggaucuacuggcagcuucugaaggcuucuguaauaccuuguaccccaaugaguacaaugaaaucauuagggguucuuuccucuccuuuggaaugaaacugcugcuuaacuuuucucccacugaugagaugcggugaugcugucacaguugggugguugcuccuccugcagucuucuucccauugcauguucacucucuuccccacuugcccacgagcagcaacuccuguuucuuguuuuuuuccuuuucuuuuucuuuucuuuugagacagagucucgcuccgucgccugggcuagagugcaguggugcaaucucagcucacugcaaccucugccuccuggguucaagcgauucucaugccucagacuccugaguagcugguauuauaggcgcacgccaccaugcccaccuaauuuuuguguuuuuaguagagaugggguuuugccauguugcucaggcuggucucaaacuccugacaucaggugauccaccugcaucggcuucccaaagugcugggauuacaugcaugagccaucgcgccuggcuaggaacuccuguuucuguuuuuauccucuucccaagucugcaggccccgccuggcccacccaguccuucuuagaagaugaugaccucaacuacugcuuuuuaaagaagacugacgucguguuaacugaguuucgauaacgccccucuguguauuuucucaucgucuuauuauguuuuccaaaauaggaccuggggucgaacuccugaccucaggugauccgaccaccucgaccucgagaagugcuggcauuauggaugugagccacugccccugcccuagaugguaucaccuucaaagcuuaauuaggaagaauaauaugagcacugaguguaacuccaggucggguauauuaugucccucuguguucucuagcuaguuaucuauccauccaucucuugccuuguccacagaaguuacagguaggcugccgggcgcaguggcucacgccuguaaucacagcacuuugggaggccaaggcgggcggaucacgaggucagaaguuggagaccauccuggcuaacacagugaaaccccauaucuccuaaaaauacaaaaaauuagccaggcaugguggugggcaccuguagucccagcuacucgggaggcugaagcaggagaauagcgugaacccgggaggcggagcuugcagugaaccgugaucgcuucacugcacuccagccugggcaacagagcgagaauccaucucaaaaaaaaaaaaaaaaaaaaaaaaaaaaaaaaagaaagaaagaaauuacagguaggcuagagcacggaugagcaaacuguuuuuauaaaggaccagagaguauauauuucaggcuuugcaggcccuaugacgucugucacaauucacuucugccuuucuacugcaaaaacagccauggacaauucauaaauuaaugugcauggccguguucugauaaaaguuuauuuauagacacugaaauuugaauuccauaugucaugaaauuauauuuuuuugauuuuuuuuuucauaaaaccagucuaaaaaagccauggguuauuuugucauggcacguuuugauaugaauauuuccacccccauuauuugcauaacaaauuacagauuauccagaacaggugggcuguacauaaacaggcuggugggcuggauuuguccuguggacuguaguuugcugacauccaggcuagauccuuaauauacaaugaaguaguaaaacacauguaaaaguaaaaagcaggcgaaauagaauaaaauacacauuugcacaccacaguauccaaaaagguuauguacuggggcuaaagauuuggcuuggaguuuccugguagucaaggcaaaaaagggaaacaaaacuaguuacagaguuucucggaccuaugagcaaaaggauuuccauuucuaaucggaggcagagguaucauggccuucaagaaucuuccgguuaaacacgguacugaaauuugauuuuauugucuaucguugagucccuaguuauuuugccuuuaccaaggcuaguugcagaguauuuguucuaguauguaaaaucagcaaucagccauuuucuggucauuguaaugguguaaauuauaucugacaguuguuaauuaaauaccuacucaugcuuuggagccaaagccaaauagugcucuguaaacauuaugauuugucaguaaucaaugugauuuguauaauuugugagcaaucagauacuuuauccaaaagcggauuauugaccucugugcccaucuugggagaaauugccacuuggucugugucuacacagacccaagaggagaagggauuugacaauggucugauuaauugaaucagugguuugggggagugggcugucuguauugauccaauuaaauagauaauugucagaaucgaggucaugucuauaagacaccaccauuucaaagccaaagagauuguuucaaacauaucaugcucaccccaaucaaugugggccgccuccuccacaugaaaucaaccagaaagugauugauucugcagagccauaaaccagggucuuuccuauuuucggcaagugguucugugcuaaauacagugcuuugaaauuuuuguuccccauagacccaaggaugaugauucauuaugcaaauaauggggauagaaauauacaaauugaauguuagggcugggcgugguggcucacccauguaaucccaacacuuugggaggauaaggugggcggaucgcuugagcucaggaguuggagacaagccugggcaacauggcaaaaccccaucucuacaaaaaauuuuaaaaauuuagccgggcaggcaugguggcucaugccuguaguuucagcuauuccggaagcugagguaaggaggaucgcuugaaccuaggaggcagagguugcugugaggcaagaucacaccacugccuucuagccugggcagcagagugcgaccuugucucaaaaaaaaaaaaaaaaaaaaaaaaaaaagaaaaaaaaaaguuggaaugacaucagacucaaaaugugucacuuagcaguggggaugcaauucugagaaaugcaugguuaggugguuucaucauuguggaacaucauggagugcacguacacaaaccuagauggugccgucuacuacacacacacuuaggcuguauggucuagccucuuggucuuagccuacaaagcuaugcaacgugugauugggcugcguacuguaggcaguuguaacagugguauguguauaucucaacauaucuaaacauagaaauaguacaguaaaaauaugauauuauaaucuuugggacagccaucauauaugcagucugucauugacugaaaguugucauguagcccaugacuaucgucucuuuuaggggaaaaaacaaaagcagaaagcaagcaagcugguauccugcguaucugugagcucaggaagcagcugcaugugcauacuggauaagcaagggagacuccaaccccgggcucucuaaggguguaauuguugcaggcacacugaggggcagaccucugggucuugguuagugguccagagagggaagagagcaaagguagaaggcuugaguuuaauuucugcaucagacucaaaacccagcuaaucuuuucuagcuggucauuucaaccuagcuggugauuucaggcuaguuaagcaaccccucggauccucaauguucuuuucccucuaauggggguaaauauacuuaauucacugggugacugcauccauaccaagcacacagccgugaucaguuagccucucacuucucuacuaauccccacuguggggaagagcucaucauuaacaugccuuaucugacauguggcaauaacuucugccuuucuuaugucaucugcaugguugcaguggauagucacuggacaauugaugaacaacuacuacaugcuagaucucucccuggggagagugcuugucuuugaaacagucaaaggaggaaggaagaaaagagaggcagaacaauuauaauaaagcaacuuaacccauugagagacauaaggaugcugcaaggcgcagugcuggauggagaggacagugccuggggcagucauggaagacuucuuagggaggugacuuuuuaagggguuuugugaucaaaacuauggagucuuaaguccaaccagugguuaugaauuccggcucugccacuugcuauaauagcuguaucaccaugagcgauaacuuaaccucuuuguggcucaguuucuucauauauaaaauggggaucaugauagucucugucccaggggaguuaggaggauuaaaugcaacaguaauccaaccacaguaugaaaagacaggcuagcacauacaacacaaucuauaaauguuugcuauuauugucauccuuuuuauuaguauaucaugguacaaguuugcuggguagaaagauggcgauggggaaggggacauuucaggccaaugugauaauaaaaucaacagacaaaagaagggagaguguggugaguaggauaaagcucuguacagaugcaaggggaaggguguugaugucaacacgcaugcagcuucccacacgucguguggauucuuuucugugcucuccauuacggaaucucccugaaaauaaguggucacuuugagguuugaugguuuaauucuaccacaaaaguauaaaaagcaggcagccugcuguuuauagauuuuuuuuuaagugagggaguauguuaaugagcuuagauugucagggagcuaaggggauucuugacaucaaauuguggguagcuaaauaggucaccccaaguuauucagcauggguggaagaccaagaggauacacaagcuucaaaaaguuuucagggagagcaagagauguucauuuaccucauucaaaauggaaucuuuaaugcuaguccagugcuuggccaguacaaggccauuauauauuuguugaaugaaugaauucgugaauauguuuauaaagacaaggaaacgccauucugcaaaucuacaugcaguaaaauaguuuuucagucacuuugccuucauuuguuugacauucuuggaauauuugggcucuacaaggugcuaggguaaggcacgcaggaugcaagauuagcgagauauugucucuacucucaagaaacucgcuuucuuugggaaucaucaccuguuuuugugucacggaccccuugggcauuuggugcccuuugcagaauaaugguuuugaauacauaaaacgcacgggaucacagaggaaaccaaucauauuaaaauacaguugucaaaauauuaacucaugggaucuaguaacaaauguucuuccuucuuaacccauuaaagaacacagcucauggucgguccauuaacuacuaauuaucaaaacagugggugaaaacgauguuuggaaauagcugcgacucucgcgugauaggaaaauaucugugauuucgauugcgacaaacacacagaugcuucucacacgaucgcagugcauugccuaaaugacaguaaugcuaaacuccagucagauguuagugaaaaauaaagauguaacauuuuggccaucuguguacacccccucuuucuaggguuccagccacagacccucagauuaaggagucugcacuagcuuguagcuuguucaaucacacauacacacaaaaagugccaguuauaaaggagcaggagguuuucuggagccaggaugagcugggaccaacaccagcaacuguaucacccaguucacugagaguuaaaaucacccaugugacguucucucugcaggcacauaguaagugcuggauaaaugauagggauugauauugaccagcuuugacacaugaauaggagaggguuaggcaaagacaaagagagauggggaugccaaguacccucugggcagaggaaaccaugagugcagaggcacguaggccugaaacaggccagaaagcaccaagcaauuugcuuuugcuggugaaggagguauaaaagguagaguugcaaagacuggggauggagcuuuaggcugggaucagcgcccaaugggcugggaugacaagugcuuggggcacauuggcagcugcgaaaagcucgcucugaugccuguguggggacagauuuugggggcaagaggacucuccagcaaucuguggcaaaaaaaaaaaaaaaaaaaaaagucccgcuuguuaucaagccuacuggcuuaucuguuauuucuuggacaugccccagucgcuaguaaauaaagcugucuacuuuacauuuugucucugugcccuuuuacagccuuuucucggaggagcugagucccauuauauuccgaaagcauauguucccgaugauugcucauucucuuuccaauaauaucuuugcaggacaaagaggaauggggaagggaacauacuuuuaggaugucagucccaguuuuaauuacaaguguuccugguuguggcauucauguaauugggggcugauuuaugccaaaugauaugcacugauguaaggggcuggagcccaagagggaggggaggccaagaagaggcaguggccccccaccaagcccggaacugagguggcacaugucagcggcuuugcucagaagcacccagggaugauggaaaaggcaaccgaaagggcucagcuucugcagauagagucugugcuuugcacuuucuggcuuugugaccuuucugcagguuacuucucuccccugagcaucaguuuacucagcugaaaaaugcaucugcuaauaauaccuauggcauaggguuuggggaggauuaaauaagauaauguaaauagaguuuagcgugguacuguguauauagccagcacucacugcuguuggcuuauugaaaaaacaaaaauaauaccuacaauaaccacaauauagcaacagcaaucauguucaagucuguauuugguuuaaggagggggaaugugacccgggggcucugucauuagauauaugcacacacuugaccuaauggaaagcuugaaagcaauuggaugggaaaacaguccaucuuguuggaaggcugucaagcuguguaauaaaagaauuacuguucucccuuugcauuuaugcauugcaugucucuguugaauucagagugcuuuauagaccucugaucagcuuccagcauccucuugguaugaguucuagggggagaugaggaaugugccuaauucccuugagugauuuacuugguguuacccuggaguugugaggacaaaaggauggggcugacugagacuggggauguucaucacaaaguguucagguuacauccaggcugauuacuggccaggagacuaggcauucauaguggggcguccuuuaaggucugaagaggacagugaccauccaccacaggcaaacauguguguguuaaaaaggaaugacguuuuggucugugcuacaacugggaugaaccucaaacauuacgcuggacgugguggcuuacaccuguaaucccagcacuuugggaggcugaggcagguagaucaccugaggucucagaaguucgagaccagccuggcugguggugauaccccaucucuacuaaaauauggugauaccccaucucuacuaaaaauacaaaaaaaaaaaaaauuagccagacaugguggugcaggccuguaaucccagcuacucgggaggcugaggcaggagaaucacuuaaagucaggaggcagagguugcagugagacaagauugugccacugcacuccagccuggaugacagcaagacuccaucucaaaaaacaaacaaaaaaaacauuauauuaagugaaagaaaccagaugcaaaagaugaccuaacaugugaaucuguguauacaaaguaccuagaauaggcaccuccaaagagacagaaagcaagcuagugauugcagggggcugggaaagaggggacuagagaaugacugcuaaagcauucaagguuucuuuugggguugguuaaauggucuagaauuagaucguguugaugguuguacaaccuuguaaauauacuaaaaaccacugaacuguacacuuuaagugggugaauuuuauuuuaugucuuauuuauuuauucuuuuagggacagggccuuacgcugcugcguagguuguggugcaguggcacagucacagcucacugcagccucaaacuccuaaggugaagagacccucccaccuuagccuccucaguagcugagacuacaggugcgugcuaccgugcccagcugauuuuuaaauuuuuuuuucuuuguuuugagacggaguuuugcucuguugcccaggcuggagugcaguggugcuaucucagcucacugcaagcuccgccucccagguucacgccauucuccugccucagccucccgaguagcugggacuacaggcacccaccaccaugccuggcuaauuuuuuguauuuuuuuaguagagacgggguuucaccauguuagccaggauggucuucaucuccugaccucgugaucugcccaccucggccucccaaagugcugggauuacaggcaugagccaccaugccuggcccugauuuuuaaauuuuucauggagacagggucucaccuuguuuuccaagcugaucucaaaauccuggccucaagcaauccucuccucugccucagaaagugcugggauuacaggcgugagccaccacaccuggccgcuggaaauacauuucuaaagaggaaugggagucaggcuggugaagaaacacgugagugugggaugaggauggggacacagagugaugugaggccuacacaacaggaguucaauccuaggaccugagcugauguaaaugaagcaccgccaggcccaguuggggaggaccuuguguuccugcuggagagugagagucccucccuccccauuccacucccaagagcagugaagagucaggaaggugggcuuguuuuguuuuguuuuguuuuguuuugcuuguugagcaagggaaugcgguuccccugugucggacuuguuucagaaagacaaugucacugaggcuggggcagggagauuagcugagaggcucuugcaguuaucugggaaggagcuguccauaaaggccugaguuaagacaguagcccuuuggguucgauuuagugguggcuccccaaaagauauguucacuggaaccuagacauuugagaaaaagggucuuugcagauaaguucaguugaggaucucaaaacgaggucaucuuggguggacccuaaauccaaugacagguguuuucagcagagacagaagugaagaaggcacagaagagaaggcggugugaagguagagacugagaucggagugauucccccacaagccagggagcacugagggcugcuggcacccccagauaccaggagaggggcacaaauagguucuccucagagcccccagaaggaacuaagccuucucacaccuagacuuuagacuucuggccuccagaauacuaagaaaauaaauuucuauuguuuuaagcuaccacacagaugcaggaaacuaauauacccuuuaaugauuuucuccauggccuuucugauaauccuuucauccuucaucuccccuguugccguuuucuuugcuuugcuuugcuugcuugcuuuuuuuuuuugagacggaguuuugcucuugucgccuaggcuggagugcaacggcacaaucuugguucacugcagccuccgccuccuggguucaagugauucuccugccucacccucccgaguagcugggauaauaggugccuaucaccacgccgagcuaauguuuuuggauuuuuaguagagauggguuuuagccauguugugcaggcuggucucaaauuccuggucccaggcgaucugccugucuuggccucccaaaaugcugggauuacaggcaugaguccccaugcccagccccuguugcccuuuucaaaacacuaagugcaucauguuaaccuuccacucgcuucuuuaaguuuccucacuccuuuuaggugaacaacccaaacccucauaugcccuagaggcccuuuucagcccuguugacacuucccuucucugugcuuuagucacccuacccucggucaacuccuaacuccugccugccacagggccuuugcacauccucugccggggaggcucucccuucaccuucauuagguuaucagaucucagcucacacaucacaucuucugagauaccuuccagacuccccuggccacggucacuuccuuugcuguggacucucugggaacuguguccccuuccuucucacaucagcuugcaguucuguacuuguucaugugaucauugaucaggguccauuuucugcuccagacaaugaucucuaucuagaaagaaucaugccugcuuuucugcacucuccugccucuaggggagagaacacagagccuggcaugugguagacucuuuuuuuuuuuuuuuuuuuuugagauggagucucccucugucgccuaggcugcagugcaguggcgcgaucucagcucacugcaaccuccgccucccggguucacaccauuuuccugccucagcgucccaaguagcugggaguacaggcgacugccaccacgcccggcuaauuuuuuuuuuuuuuuuugguauuuuuaauagagacgggguuucaccauguuagccaggauggucucaaucuccugaccuugugaucugcccaccucagccucccaaagugcugggauuacaggugugagccaccacgccugggcggcacgugguagacucuuaaugaauuuuugcugaauacugaguaaauaaagaaaaguuaacacaguggaguccagguacaguggcucaugccuguaaucccagcacuuugggaggucaaggcaggaggaucacgugagcccagcaguucaagaccagccuuggcaacauggugagaccccaucucuacaaaaaauaaaauaauuagcugggcauggugguacaugccuguagucccagcuacucaggaggcugaagugggauaaucagcugagcuggggagguugaggcugcagugggcugugaucaugccacugcacuucagccugggugacagagaaagacuccaucucaaaaaaaaaaaaaaagguagagaugguggaguggugacauuugguagauaauauagcucugcagaacuuuucauugcaaaaugaaaauucuucauuguuauuauaauuacuucaaggagcaaggccauuuuguguaagcuauccugggccucccugccucccauuuuacacccuguuuauugauacuaagaagagccuccaacugaauaagaacuaaugacuucugccugccaucauuuuggaauguccaauuccccguucuggagagccuuugauuauaacaucagccugucauuuggaccucugaccugaauuauaugaaucugaaaaaucucuuccuuuccuaucgugaauucggucauuguuauaagccaagcuuugcaaagguggaacaccuuggagauacuuaucuccuccuuacucuacccaaguaaugacucauccuuuuauacagaaugucucuuuuuugauuuagaugucuuuuuuugauauagaugucucuugauauagaagcauuucucgggaugguuuuugugguugccuagugucuucuaaagaccccugaacauagcauagaaacagcacgugucuuaggcuuggaaugagauaaugucucaguguuugaguagaauuagggaguuugcuuuauuuuccuuuguuuuucuuuuuuguuguuguuuguuuguuuuugagacggagugucgcucugucgccuaggcuggagugcaguggugcaaucucagcucacugccagcucugccuccuggguucacgccauucuccugcucugccucccgaguagcugagacuacaggcaccugccacgacgccuggcuaauuuuuguauuuucagcagagacgggguuucaccguguuacccaggauggucucgaucuccugaccucaugauccaccugccuuggccucccaaagugcugggauuacaggcgugagccaccacgcccgacugcuuuauuuuccuuuguguuccuaauaccuggcccagugucuggcaaauggaaaguuccccuggauguaguugggugacacuaugaguguaucguuaggcauguucaaaauauagcuaaauucaguccagacauucuaccuauguuuucacagaaacaugaggcaguguacagcgcuuaucuguggcauuugauuaggacauuuuacugaagaguugauaaaaaagcacaaauuguaggcugcaaaucuaucauuuuucuuuccuccuucuuccucucccucccucccauccuuucuugcuuucuucccuccucucuccuuccuucccucccuuuccagcuuaacuaaaauuuucugauacuuuuuuccugaauuaggguauguuuuggggggaaaaaacgcuucagugcguguuucuuucgacauuacacauaagcccccauggaaagcaaauugaauaaauuuacucucuaaacuucuuuccacaagaguagguuuauaauuuauuuucuuuacauuaucuggauaauuacauuugguuugcuuacauagauggaggcgaaugguuuuccaaucuucaaaccaaccuauaucacaaaagcauucugaaaacugggaagagaucacuucacaguuuccugaaccacuagaaaaaaaaauguucauaaauuuauagccgcugacauugaaguuggagaaaagagcauaucuaguaccuaugcuauguggagaacacucuccaugucuuugaaaaauaagcacaauacaaauuauauuugaggaugaccugccaaaggguugauuauccuggaaacauguuuucucaaugguccauuugggcaaacaggccagcugagguaucucaggauagcaacaggauaagcagaaucgauugaugaaggagggagccuaccucuggaggccccaggcugggacuuuggguacagaugcacaggagaccuuugccccaccccgucacggcugggccuacucaguuccacgucuuugaguuuucacgcggaaacuggauguuucuuacauccucagcugcaggcauggggaagagacgcacaucagccauuaagaaaaagguaugcagucuacaugccuguuaauuuccuccacauacacaguaaacccaucauguccaucagcaccauugucaaaacaugugugcaccaguaaaggguucugaugugugauaaauuuauuuagcuauuacucaucugaaguuauacuauuuuaggaucuuggggcagugaggacuuuggaaauggaacaggaugcuccuuuaaguuaggguaaaaugaagucuauaaaaacuguuuuucuauauccuccuccuaccccacaaagaaaguuaggguaauauauucuuauauaaaauugacauuuuuaacuuuaaugagaaauugcuuguccuuuaaacuuuaggcauugaugcgcuuaauuaugcuuuucaacaagauuuugcauuuuuaauauuuccuuuuagagcuuccaggaaucucaauuauuaauuguacccuggauuuauuggucuuuggacucucccgcuaguauaaagacuguagauucaucaaacauuguuuacugucuucaaacuucaacaguguuuuaacuaucaaauagaaaaucgaaaggaagcauaaacgcauauggucacuuuacugguauaauaggggccaagagccguuguguuuuauaauuucuugaugauccuggugguagguaagccaaccgcuaugaacucugaugagcucugguuuaccccauaguccaaauaaagaaugguuucugacauuguaugaccaaaaaaaauagcaucugcccaaaagaugcuauuuauaaaacuguuacaaauggagcuuauuguucaccagaauuuuaugaauaaguaaugaagucuaauuuuccguuaucauagccauugguuaaaaaugcaugucuguuaggacauuguaauuauuuuguauuacuuaggaaaacuuuuaugauucuacucuuuuaauuuuuuuaauaauuacuuuaugacuucuucauuaggguuucucuccuccagugcguacgcagaucuucugaaaaggaaucugacaaauuuaguugcugcauuuuucuaaauugcuuucaagacuacccagcacuucagauacuuuucauggcccuuuuuucccaaaguguucuccaggaugccuuuugaucugcacgggcaaucccauuagcagugauggcuuaagguucccacagaaacucugccacagaggcacugacaccagaccaggcgugaucccuaacagcuugcuguaccgacucauaugagggcugucuugguccgucucauuuaagguuuggcuucuccaaagauuagacacccuuguuuucguucaaccuuuguuuggcuuugaagcaucaugcacuugggucuugaaaucuugggcucaccgcugcuuguaccaguaucuucuacccuccgguuguuuguggccauuaucaaacaaacaccaugccaacuagguguaaaugcagacugauauucugaagaauccaggaagggcugggcauggugccucauuccuguaauucuagcacuuugggaggcugaggcaggaggaucgcuugagcccaggagcuuaagaccagcuuagggaacauagugagaccccugucucuacaaaaaguaaaaaauaaaauaaauuggcuggguaugguggcacaugccuguagucccacccacucgagaggcugugaugggagaaucacccgaggcuggggagguugaggccgcagugagccgagaucgagucacugcacuccagccuggacaacagagugagacccugucucaaaaaaaaaaaaaaaaauccaguaggaaacuauauaaacacuaggguugcuuuaaaaugucaaggccaacucuuaugauaugcggaagccuucgcccccuucuugaggguguuuagggauuagaugagugucccaucuggguuucccaucccugcagagcccacguguggggugcugagagguacguggugggugacucccuggggagcacuguuugguacugaucacugucccauccuggcacugcaguccugggacagucuacacagcuccugccuccuucuuuucuucaggauuaucucgaguugguuugcaaagugaaacgcauuagacaucuucaagugggcugaagaaagggacucaauuuuuguggguccauguuaauguaauucuuaugaauuugagauaaaguggucauuaaagccuagaaggaagggaaaagcuacaccccccuguggauguguaugcuaaacuugauugaucugggcauauguggaauuuuuaccuuuguuuugucuuuauuuauuuuuaaaauugagguaaauuuacuuaauuuaaaauuuaucauuuaauaccaucuuuuuugaaugguuaaauaguggauguauuuuuucuaguuuuuuuguuuugcuuaauaggcucucucucugucucuuucuuucuauauauauauauaauauauagaaagauauauaaucuauauauagauaucuauauaauauauauaaucuauauaugauauauauaucuuauuauauauuauauauauagauagauaucuauauacagauaucuguauacagauaucuauauauauagauaucuauauauauagauaucuguauacagauaucuguauauauauauagaaagagagggaacugaacgggaugcuuuuuauuuugggcuguuauuagguagacucuccugggacauucuacacagcuccugccuccuucuguauguaauauauauauuauauauauauaaaauauauauuauguauagauaauuuauauauaaauauguguauauauauauuuguuaggguaaaacaaagucuauaaaaacuguuuuccuuugucauugcccccaccaaauauuuauauauauguauauacacauauguauauauguauguauagagagucuauuauauauauuacauauacauaauauauacauaauauauaauagacucuauaauguagacucuaauauguagucuauauauuauauuauaauguauguaauauauaauauauucuauguaauauauaauauauucuauguaauauauauuaauauguagggaauauguuacauauuauguugagaguguauauauuauauauggguuucuauauauuauaauaaacccauauauaauauacauaauagacuauacacauauacagcuaauauauauacacaauagucuaguauauauuauacauguaauauacuuuccauacauacauauauaauuuggggggcaaaaacauauauauaaugaauauaauuauauaauucauauaauauauguaauagagcguguauauuauuuacauauguauauauauauauauacacacacacacacacauuucaacuuucuugaacuccugaaccagccuuagauugccuaguaccaggguucuucuuuuuuuaaaaaauuuauauuuuauuuuaaguucagggguccaugugcagguuuguuauauagguaaacuggcgugauggggguuuguuguacagaugauuucaucacccagguauuaagccuagugcccauuaguuauuuuuccugcucuucucccuccugccacccuccacccuuugguaggccccagugucuuuuguuccccucuuugugucuaugugcucucaucauuuaguucccacuuauaagugagaacauaugguauuugcauuuucuguuauugaauuaauuugcuaaggauaauggccuccagcuccauccauguuccugcaaaggacaugaucucauuauuuuuuaaggcugcauaguauuccacgguguagauguaauauauauauaauauauauauaaaauauauauuauguauagauaauuuauauauaaauauguguauauauauauuuguuaggguaaaacaaagucuauaaaaacuguuuuccuuuguuauugcccccaccaaauauuuauauauauauacacacauauguauauauguauguauagagagucuauuauauauauuacauauacauaauauauacauaauauauaauagacucuauaauauagacucuaauaauuauuuuuuaaggcugcauaguauuccaugguguagauguaccacauuuucuuuauccagaauaaacuauuuuuuauacugguuuuaggcucacagcaaaaucgaguggaagguacagggauuuuccagauuuccccuggcccucacuaccacaugcguagccaccccuuuaucaacaucauguuaacuauuuuaaaguggacaguugaguggcuuuaagggcauucauauuguugugcuaacaucaugaccauccaucuccagaaugauuuucaucgugcaaaacugaaacgcuguacccacagaacacuggcuccucaucaccuccccaagcccagccccuggcaaccaccauucuccccuacuuugucuaugaauucgacuacucuugguaccucauauaaguggaaucacacagugugugauguguucuuuuguggcugacuuauuuaugauacuggauucucagcaucaugggaguuaggacugucugucgcaccaucaaacaggcauagcuggcuggcuagaccaugucacagggauguuggaacuggguggcacugacuggcccagccaaggggucacgcaggggacuccugauucauuccuggggaaaguaguuaugucaggaagcacaggcuauggcucacggcuguggcugugcccacguggucugugugggcuggugguaaugggccagggaacugaaugggaugccuuuuauuaugcacucuugacauuuuuuauauuaaucuguuuucuucuccaucuauaacauuucccacaugcuacacugaagggauauuuuaagcauuaauucuccuaaaaagccucaugcccaauguaaaaauaguucacugucucagaaaaaggcacucucuauaaaugaaaagcaccauuauuaguaaugucaauaacuuuccugacauccauuugggcauuguauauguuuugauaggauuacauaaauaaugaaauuguaugcaaagcaucagaaugcaaaagguguuuucuccaagguguauacacugccugggccuuguacucuggcccucaauuuucuuaaacagcugcaucuuuugggggcucuguuaagacaugcuacugucuuuaguauuuugcccccucaccgaaugaucaggagacuggcuuccccaaugcccugggcuuaauucccagauauuuauucuguuguggagugauuaucuguuccuggauugucucaaaggcauuaaucuuuuugguauccaacaucuugaaugcuucugugucauuuuccuuucuuuuuuuuuuucaaagcacuuaauuauuuaaaaacaaaaauacuucucugaucagagcauaccugccgugcucaaagcacuugcuuacuuggaaugccauaaauuacaugaaggaauuauucauuguaucacgaaacauaccuuccagucucccgaguaguguauuaggcuaaguauggucuuuuaaauuauuacuuuaaaaauaaaagauaauggaauuauagcauuaaauacauuuugcaaaugaucuucuaguaggauuauugaaagacaguaaaggcaaguauaaaucagaagcaaaaucauuguccucuaauucauuaaugguuaauaauauugcugacucuuuuaacuugucaacauuuccuacauucaacauuguacucuaauauccaguaaagugaaacaaacaaacaaauaaauacacuuuuuucaagaaaaaauaaauaucugugaucucaucauuugaccgucaguauuuucauuuuugcaugugccacuuuaauuucccuaggcaacacuagcuaguggcccacaauaagacguagaaaacaagaccacguaccuuccagaaucauuggcccuggcucuacuccuggaaacccaguccaucucuaaucccuuugauuuccaaugggaggcaaauccaggggaguucuagacugucuagaauauuguaccaagaacaaaaggccaaccccauuagacaguggccaagggaggugaacuaaaguuggugcugugaacagggcuaaugguuugugauuuacccauaaguggaagguguacuccggcugcuccuuuaauauuuuaugauuagcaguagaggugugucugggggaaagagucagcuuauuuuauuuauuuauuaauuuuuugagauggagucucacucuaucauccaggcuggagugugguaggugggaucuuggcucacugcaaccucgucucccggguucaagugauucuccugccucagccucccaaguagcugggaguacaagugugcaccaccaugccuggcuaauguuuguauuuuuaguagggacgggguuucgccauguuggccaggcuggugucaaacuccugaucucagguguuccaagaacaaaaggccaaccccauuagacgguggccaaguuggugcugugaacagggauccugccucugccucccaaagugaugggauuacaggcgugagccacuacacccagccaagaauucagcuucuuaaaggagcugccucagacugucucaagaucuuagaaggccaugccuacauugccaccagcaucccuuggcuuuuugcuuggcuuaagaaucuaucuuuuccguuccuccuuccagcauacucagcacaguccaccucuguggucucucugugguuuucuuucuguuuuccugcucucuccauuucucauucaccacacccugggcuaucuuucacucucuaugaaauaccuuggauuuaggaauuggagauuuccuugggucagguuucacccucuucaaguagcgucucaaacaguauacccacuacagcuuucuccccacucugucaaccaugccauggggccuacuuuuugcccugacucccaccagauaaugcccaucagauggcaccucuuuuggcugaaaaaucgaaaacucaucacucuuccugcauucauuagacaguacccuuuauguucaacuuuguaauuuaagucccauucuugccucauagaauuauugcccguugaccuccauauaaguaucugcauuugcugcaucauucaugacaugugaggccuuugacaaacccuccuauggugcagcuuccuccgagcagcuccuaaggaagugccagagucagggcuuuccucugccugaauuaucggagcucuuggcuuaaugugggagaagagaugaaugaucuguccuucuaugaaaggcuuaccaacuccauucaauucacaguggcucucugaagcucuguuuuuggaaggacugugaggcuguaccugcacuugauugaacgagugcugggauugauuagugaugucugcagugagcgaaggauugggaagaguaaacaggcaugcugcauaucugucaucauggcucugaguguauccuguuucagaagagaugaacugugcuguagagauguuagcaucagguauuuuagacacaugaagagaggaucagauucaguggaagugccaaagggauucuuucagaugggcaauaagugguucugaagauacguauuucucaguguguuaucuuggcuccauuuagccacacaaaaggaauauggguauagugaugggucucucauggcucacguauuaacuguauuuguuguuacugcuucucaggcacucuguuaagaaugcagggcucuuccucagacucagggcggggccugggcuuuacagcaaugguuuucaguuuguaaucucucucaaggaagggagaggagcacaaagcugccuugacugccagcaccaucagaaaagugacagcagucuuggcccuguaauugccaacaguaauucauuuguucguucucucucucucgcuccugcuccugacucugggggaugcuucuuuuccuacccugccuggaaagugcuggggcaugggugaaaccagaaugguuuugauucucaagucuuuuuguagagaggaagaauggauauuccuagggucaguugauugaggguguguugggggaaugugauuaucgaugaugcuguaugcuggguacuagacuggggguucguuacaucaaguuguggggucuguggaaaggaaguugucauaggagucuaggacucagcagcugucaccuucccaaagucacacugcugaugagugacagagaccacauuuaaaucuguguguuuacaaggucuacaacugcacccugcuaccucccagaagcugaggcaggaugggcagguugccacacccucccaaccuccugcaaccuuaguuguuagugaaagguuauuaaauaggccucacaaucgcaagccagguaaauaugucauuggagagguugguuuuguuugcauuucuggugaaguugaguuguuuuuauccccuacaaggucaucuagacauuuuuauccccaaggucaggagaucuuucugccagaggucagcauuccauccagcuccugccugcucucuggguggccgacugugccaguagaaaugccagcugcagccaaaggacaggcuuuccauccgagaaaagcacucacacucgcauuucuuuucugguucuguuccuccccuacauaaccagaaaaagcucguuaacacaugauggcaaccaggcuccaauaucugccaguuccccuguacagauuccucuuuagcauucucucggcuucccuccucaacaauuaauucagaugagcaguugggagagugcaggauccaguucaaaaggaucuguccccccgugaaccccaggacagggugagaggccaccugcacacuuuuuuuuugucagcucacacccuguuggcccuuugcaaauauuugucuuuccucaugcacgugguuauucccagaaagauccagugaauugucuccugaagauaaaauacauaaaagggcguuucaaaguauaaacagugauuuuaaugaaaaauaagaagaaaaugcuuaugauacaacauuagguggaaaacgaaggaagaaaaauucugugagucuaauuauggaaaaaauuacuaagauauguuuuaacaugcccuagacaugcacagaaaaaaaagacuggaaggaaauuuauugagauguuauuguuuaugaguguucuaauuaugauuuuuaacaauauauuaucagaguuuucugacaaagaauuaacuuuuuauuuuuuuugagacagaguuucucucuugucacacaggcuggagugcaauggugcaaucucagcucacugcaaugucugccucccagauucaagcaauuuuccugccucaggcucccaaguagcugggauuacaggcacccaccaccacacccaacuaauuuuuguguuuuuaguagagacaggguuucaccauauuggccagacugcucuugaauuccuaacuucaggugacccaccugccucagccucccaaagugcugggauuacaagcaugagccacugugcccagccuagaaauaacuuuuaaaucagaaaaauacauuuuuuaaaaagauguaaagcauacauagaggauaacuuacaaaucugcauuucaugaccacauauaucuauugaguugccccuaggaucauuuuuuucaaagcuaaugucugccacaaaugggaguuuuaauagguuauaauucauaugacuuaguguuaaaccucuacguugggauucuuaaauuuaacauggauaaacugaacuugauuuccugcauuaaaaaaaauuaaagaaaugaaaguucugacuguuuuauuguagcuggggaauucuuuuugcaggugaugcucauguuacgguuuugaacccaggacuuugcguugcaguuuuguucagggguugcagaauaccgaucugacuuugcaggaaugacugucuuggugcauaagccauuaaccucucugcgcccuuggauugccuccucuccugccagcagaagccaagucaccucaucuguaagggaguuucauugaggacuaagugggaccaggccgaaaacgacccccuucccccauaggaagucacagaacagccaagcccuggaacaggaggagcagcuuccuccugggcacagcugugcagaaccagaggcgacgcauuugcccaucguaaaggcugauuagaaacaguugggucccaagcagaauccuuuugcccaugacuguguccauggucgagguguccauugucacuguugccagaugccagcacuggcgaggguuuugccuuccuaccguaggcuucuugacccggcaccucggaaaguaacuccuguccauuguuccuugugccaucuuucuuaagaaaacaugaggaggagcagggugaugcuagauggaagcaggagagccuggggucuuaguuucaguggcucugacuucaguuuucucaccucgaaaucucccuucucugaaccuuuuugcgugcucuucugucugucugauauucaucaucugacucaucucuaccagucaggaguugcuucuuccaggaagccacauuccauggacugauacgcugggcuccaugccauccugggguucucuugaguacaucuggagggguguaguguguuguaaaugcauacgaucaugcugguacauuucaucaaagguggcaguuacacuaccaguugugugcccuugggcaauuagcaucacccugcugugccucaguguuuccaucuauaaacuggguauaauaaucauuccuaccccauagguugcugugaagauuggcucacaucaguaauguacuuggaauggauccuggcauaaaaagagcccuuggaaaaugauagcguucauccuugguaugaccuccaaguucuuugaaccucaaagagccaagucccacaucucagguacauuucaguucauucuuucugaguugauuuuuuuuuuuuuuuuugagacaaggucucauucuguugcccagacuggagugcgguggugcgaucucagcucacugccaccucugccucccaggcccaagcgauccuccugccucagccucaugagcagcugggaccacaggaugcaccaccauggccagauaauuguuuugcaucuuugguagagacaagccuucacuauguugcccaggcuggucucgaacuccugagcucaggugaucuaccuaccuuggccccacaaagugcugggcuuacagguaucagccacugggccuggccugaguugauaauuuuugucauuucuuucucacuuuucucaggaaaaucaugacuguaaaacagaucaguuuugcuuuaguucccacccucaucaucaaccccuccccagcuacccugcaaaagagucacagaucauugggauaacuagaaccacagagaucccccuagacuugucagccagggaaccugacacucuuagaccuucuucugagugcuuuguccuuguccggagagcucggggaggagcaagguuguacugggauuuuuuuccgaucacagaaaguaacuuagcuagcuguugcccagccaauuugcccaagggagagguugcuccuggguugcaggacgcauccauggauggagcauggguuuugggcuguggggggacaaugaggugguuccugaaaucccuaguuacuagcagacaagugcaucagacaagugcauuucaccguucugagcuucagucucuuauccaagcagaaacauggccagaaugcaauguccuaauacauguaauucauuacguguguugucauguaauguaacacaccuauuggcagucucugacacaauacagauauugaccccauggucuugccccaacuuaaauaaaaauaaaaacgaaugcaaaagaggaaucuucuuugcacucgugugaugucuguuaauucuuggcuuucuuccuucauaagguuaaucaucucccugucaccccucccgcuugucccccagccucugugugucaccuucucucugagcucacccucucuaggaagccuuccuugcuggaaugcccauucccugauauaaggauuccacccaccacgccccuugcgguuccuugccgguguccuguccugggcagacauaagcccuguggguuccaguuucucauuaggaaccuggaugauggagcagggaucaugcucauuaaguccgcagaacucaucagcugcuuagcagggggccaaggagggcugagccuaugacgggugaauaagucugguuggccucugggaguacgggaucagaauuccaagugacuggggucaguagcaggccaccaagagccaucccaccucagaaagacagaagccaucacugcaaauggcaagggcaugaggcaguuugaaacuggcaaaacuggaccuuucauggaauccagggcuugagcuuuaaugcuuuacacuuuuguuuuuucauuccauacgcuuuugcuuuagcuuccuggcaaaauucagacaaaccuagaagggauaauaacuuacauucaaccucugcuugcucuguccuuucucacacguguuuagagaaacuggaggagcccgggaacugcuuucuccucucuaagagucuuggugguuucuuguguggaaaugaaugggaaguucacccugguucugcaaaaugggugcgaaauguaaaauguauauaccuucuauccuacucuuuauguuccacaaauuuuggagggaaacugauuaacucucuagcuaccauguuccaggugccugcaccugcuugcucuugguuaaccugcacccacguucccccgccugucucugaaguauucacagguggaggcucagaugcacacagugauugagugcccuagcugggguuggaaacucuguccaugaacuccaaagcccacgcucucuuacacccucccaaaagcugaggcuuccucacugucuuuugcauuaugucauggguggaaacaugcaccuucccugaccuuuuggcuuggaacauggaaguucauugacuuuguugccuagcagggccuggagcuggguuucuugccugaucaauguauaucauuuugccaagagacagagucugugcuggagagauugauucccugguuauuuaucuuccucugcccaguguaaauuggucagccugauccuauucgcaugauaaaaaucauaaugucucaaauuacuuacucaauaaaauguggguuugucuauuauuagugauuauuaggguuauaaugcagcauggaaauuuggagcaaauuaacuauacaugcaagcuguugggcucaagugcaguuaaucauacgcauacagugccagugggcagaagguuuugcaagaauagcuucaggaagacuuugugggaagacagaugaauacucaggguuuuuuuuuuuuuuucuucuaacuuguccuccuugaucaggauuucucaaaugcacauuugucuaauauacuguugaaccaugcaaguaccaaaacaaaacaagaaacccagaauuauagcucaaauuuaauuaaaauagcuuuuauugcuucuauucaugugucccuggauuuuaagugaugcgucagaauuucaugaugagcaaaugccuauggaugcccucauuucucauccuucuugacugucugcuaagauucacucuuggucuugucuuugagcuuuucuguucagugauguaaugggacaggcucuccugucaucaagaguucccaucauaccugggcacugccauuuccucugugguagaugcuuccuggacacgugggcaggugagaggugcugacuuugccuacuugcagcugaagagaagagagauguagcuuugaauggccacaugaguguuuuuuuaaaugaaaaaaaaaucuauguauaacuuguuuccugugagggugccaggaaacuuuacaaugaacuucgugaauuaaaccucuaccagaugaauagaggugguggcaugguagcagaaauuaggauuaaaaaaaugguuuuugauuuaugaaaaauuuuucugcaggaaauuuugauuuguucuuuguggauucugaggauaaaauuaagaccaacauugaggaugagagacagaacugaacucaacuuaaaauagcuucagggaggaaaagcaagugcauuagauaaguaagugggaaguccagggguagacgugaguucaggcauagcuggauccaggauccgacagcuugcauguguaguuaauuuguuccaaauuuccauccugcauuauaacccuaauguuugcuaauaacacacaaacccacauuuuauuaaguaaguaauuugagacaugaugauuuuugucauguaaauaggaucaggcugaccaguauagacugggcagaggaagauucauaaccagggaauuaaucucuggauccaggcugaaaugauauuaucagacaccuuucuuucucugguccucaguuuugaucucuucucugcuagcuuuauucuaagacaggcuuagaugggauguagagagcaaacucuggaaguggaguaccucuggccuccaaggccaguaguuguagcaaaaguccagggcugccgcucauucacucugcucggaccuuucuggucacuugucuucugugguuugguccuuguggccagggacaaugaaacucucauugauuaggccugaguuaugugcucucuccuagagccaggaagaggcuucggcccugcccagacccgguggccugagagucacagugaggcgcagcucccaaagggagacugaaauauaagcaaaagaaaaggaacacguacugggaaucccaaacagcaaauguucacuguguucagggaggagucuucaggcccacaguguaggcauucaacaaacgcucuucagggagaaggaaaguuaccaucaaaauccgucguugaaaguauugaaguuccagcuggcggucugauacagcuuagauguugucccugcccaaagcucaugucaaaagguaaucugcagcguuggagguggggcauggugggaggugauugggucauggggguggauuucucaugaaugguuuaccaccauccucuugguacuguccucacgauagugagugaguuguugggggagcuggucauuuaaaaauguguggcacagccccccacccugucucuugcuccugcccuggccacaugacgugccugcuccgccuucuccuucugccaugauuguaagcuucuugagacuucccccagaagccaggcagcugccaguaucauguuuccuguacagccuguggaacuaugagccaauuaaaccucuuuucuuuauaaauuacccagucucagguaauucuuuauagcaaugcaagaauggccuaauacauggucucugagcaggauuauuguagaggggacugauguugaagaauggaaaagaaggcagugucagagaaugcugaagaguguggaucuuaaaguccaaccucaaggcccagcgcugccacuuaacagcucugugacccuguaaagucacucagccucauugagucccccauccuccccuguguagaaugaggcuaaugcuagugcucauuucauagaguugcuacaauaaucaaugagauaaugugcauaaagauuuacauacauaauaacugcucaauaaaggguagauguuaaaauuagcaucagcgagcucuagaagaugcuaaguucucuggaaagaucagcucugcuccugucaaucucuccaaauguuagauuuugccucaaauuuuaggcauucguucauucauuuauucuuucguaaauucuaucgcauuaaccuuuacaaguguuaaauuaaaucuuuuccccaaauuaugcauuagaaccaaguucuuaugugguggauguaccucauuucagcaagagcuuucuaaggguacagaauuaaauaugcagccucugggauucagugauagcucaugggacauuugaccuacauggaaaugcaggcuggaguugcauuuuaauuggcaaggaucagcccaguuguccagcuuguagcuuggaguguggccuggcucccacuccagagagauguacaucaugaucugcgugggugagaggauacucucaggaaaugggcaaaguugccagcugaccucuccagaaagagagacuauguuguuaguuucccuuacuuggaugagaaauuucuccauuccuagucucauuuucccaauagaacacggaggcagaauuuaaagccucaaaacaaucugaugcacaucagcuaucaaugaaaaggaccagcuuggaggcagaggcaccugaguuuugcaucuuggcucaaucacuuacuaacugcauuguggguuaacacagugugugugugugcacuuacuaacugugcaacugugggcaagugauguaaucucucuggagcucgucuuuccuuuuuucuuuuccuuuuuuuuuuuuuuuuuuuuuuuuuuuuuuuuuuuuuuugagauggagucucacucuguugcccaggcuggagugcaguggcacaaucucagcucacugcaaccucugccucccggguucaagugauucuccugccucagccucccaaguagcugggacuacaggugcacaccaccauggcuggcuaauuuuuguauuuuuaguagagacgggcuuucaccauguuggccaggcuggccucgagcuccugaccucagaugaucugucugccuugcccucccaaagugcuagaauuacaggcauaagccacugcacccggccacaguuuucuuuucuauauuguagggauaauaauccucccuugcaggacugugcucagcacauguucauugcucaagagaaguagccacuguuauuauuauugucaguauguauccaaguguuuaguucauuuucucugcauuugucuaacucccuuuuuucccuugaacuguaaagcucucagcccagggauauaguagcaccagcacauaguagaugaucaagaaaaauuagucauucucucugguucuuccuuuccuguauccuguugucuuuaucaguucaggcugcugugacaaaaguaucacagacuggauggccuuaaccacaauuguuuuacaugguucuggagacugggaagucuaagauuaaggcaguggaagguucacugucuggugaaggcugggcuccugauucauagaugucugcccuucuugugcaucuucacauggugggaagagggugagagagcucaccggggaguguuucucccaguuccuccccaguacacagaaaaacaaagcuuucugucucaccaggaggacuccacggugagcauagcuuggcucagcccagcaggagauuuugaaccgacucugguagauucuuccugcagccauucagcucccaccucuuucucucaaaaagaaauccagggcugggugugugugggcaacuucacccugcucucuuugucccccaggccugcacuacaacaaaugucucuuuguguccaacucuucuuccauuucuaguccuucuuuucucuucuucucguacuucccauauuccuaauacgauugguuacucaaauucuuaaacaacucacaacucauuaucucccuuccauguaaaaguaacccccagccugagcuaccugaccccgugguuuaaacaauaaagcaacugaccuuuuaucagaaauuugcaaagccauuuaauuuacauauguccuuggcauccacaaauauugcuucuccuuucaaccagcaugccacccuuccagccauucacauauguauucauucauucauucauuuauucuuucauucagucaauaaauauuuauugaguaguaagcacaugcaaggcauugaggguggggagggaaagagacacaaauuguccuuacccucauggauucaccauguauuuaaaggccacaaauacuugugugagaagcaagucuuaauagucugaaguguuuucuuagauucccuugagccgcaaugcugaaaagcuuauggugguuuugcuaaugaauuugacaaggccagaaauagaccagaugaagauugauccauugguuaauugauuaauugauugaucgacugaggaaugucagccuggucuaccaagguuuaugaaagccuggcauauagaaaugaugucguuaaugcacaaauaccugcauccugucuugaacucccucuaggggccaccauguguaucaguguccuguggcugcuguaacagauuacuacaaauuuuguggcauaaaauaacacaaaucgauucccuuacaguucuggaugucagaacugggugacuuucuccugagacuguccugauuuuuuuuuuuuuuuuuuuuuuuuuuuuugcuugucaguuuguuuugggugaugcagauggaagguaacgucacagggcagcuguauuccagguacuuggugacucuugguugcgaucugaugacuggcucacaguaggaccaugacgugagcagauuuguaguccugcaugaaugaaggaaagaaagaaaucugacaacucauugauucagauucacagacucugcauuuugaaccagaauacacccgagcaauuaccuagcacaaaaucuccugucugcagaggaguugcaggaaggagaauucacuauauccucuccugaaaauaucccuuguggucaagguggcuauagacuggcaucccucugcucccuaagaugccagggacucacgucuucuaggauaucaggggaagauacagggcaaugggccucagaucacagacacggaaaaucauuuucuauuucauggagcauggagaagcuuccuucaaaaagcuagccuucgacuuucuauuuuuugaacugaagggcaggccaggagggagcugaccuguguagagcuuggagguuguguuuucagcugagaaaagugauccugaaccucuccauccuugcaaagcucagauggaagcccaggggccccagcccuccagccccacacacaugccggugcaccuggacugccacucuaccuguuuacaaauuacccccauuuucugcuugguucagcagcaacugauuaccgucccccgugauguaauuagggcuucagaguucacgugugucuauuaugagcucuccugugcuuugucuuggugcuucguuucuguagcaguaaucauauauauauauaaaaauuugguaucaauuguuuggcuaaauuaugcacagugggccauccuaaccugccauuaacauaacguaugcuaaagaauguguuguguuuuuuuguuuucucugauaauuauacucuaaagcaucaauugcuuauuugaguaaauuaaacuuugaguuguucuuauuucuucaaacuuucaaauugucuugccugcagcagaugcagacccagcacuccggcugcugccaguggaggcaggagccucguuaccaccuuucugagaaauucaagugccacacaguggucaccagcauuguagcugcccugauguuccgggcucagcugcaauauagcacaucucuaccaccauccccagagugaccuccagaacuguaagggacccccgccuuugguacagagaugggaguuaaacacagguguccacuggagucaugauuccucuauucccuggacaaauaugcaaugagaaucccugagggacaggcacugugcuagauacccgagauacaaaagcgacaagguuucuauccucugacaguuuauacuuuagugcaguggucagcagacuguuucugcaaacagcuagauagcaaauauuuuagacuuugugacccauacagucaccaucacaacuauucaguucugccaguguaacucaaaagcagccauggcuguuacauaaugaguggcuguggcugugugccaauuaaacuuuauuuacaaaaacaagaggagggccagauuuugccuuugucaaggaaguaagcauaauagugcaagcagcacgugcccgcucuuucacacuggggcaaacacaggggauuuauucggcacaauugaguaauguggaugaggcugcucagggcuggcaguuguaggacgcaaaaccuugaggggcaucgauauucugguacagcugucacccauuugcagcacagcugggacacuccacagagaaugaucaggaaggccaagcccagauggcauuguugaggggcuuucucuuaagacugcaucugaguggcagggcgcaguagcugacccuuguaaucccagcacuuugggaggccgagguggguggaucacgaggucaggaguucaagaccagccuggccaugauggcgaaaccccgucucuacuaaaaauacaaaaauuagccuggcgugguggccggcgccuguaaucccagccacuugggaggcugaggcagagaauugcuugaaccugggagguggagguugcagugagcugagaucaucccaccgcacaccagccuggccgacagagugagacucugucucaaaaaaaaaaaaaaaaaaaguuacuucugaguuaaaauaugaagagugagcaguacccagccaugcagaaggacauggagugguaaaagcaugugguuccauuaagggaaagacuccagggcaagaaaaaaacaugucaugcuuguaccugagggaaggccagugugauugcagaguauggggcacccuggaggucuggaaugggaggaguuuaaacaggucauuagagcuucaagaugaagcauaggccagugacuugguugcugcugcugcguaaccguguggcaacugaguggcucacggcaaucaguauuuacuucucacgugugugugggguucagcagaacuaggcugggcuuggcugcccugcccuacugguccugcugguuuugguggggcuucccccugugucugugggucagcuuguuuugcuccugcaucuuugcaucagcugggcuuucugcccuaggcuggacauggguggggcacuuuagcuggggugguucuccuccacaugucucucaucuuccugggaccagcagggcuagaccagacaugacuuucuuauggcaagggcagaaaugcaagacagcaacucaaaacacauaaggacuuucaagucuagacccagaacuggcauacccauuccucugucacacacugaugccccaaauaaaucacauggcugagcucacgguuagagagggaggauacugcagucccaaagcccggggcauggauccagagaggagggugaagaaugggccccugacccaagacugcacuuguauuugaguugcauaagaagcugcugaggaauuuuaagaacaggagugacaugacuuccguuacaauugaaaaaaucaaucuggcgaaaugaauggggcuacauagguugggggaaggagguaagagaggaagugaggagaauagggugggucgaaccuguugaaggcccagagcuugcuucucuucugccgccuuuaggaaacgagaugaauuguuaaacuucuugcacugagcuuuaccaggugagcugacaguuauccucugcauucaucaauauaagccccauaaaaggcaaagugguugaggagaaacgagaaauuacagcccagauuagcagccuugagugcuccuugugaacacaagacacugacccaaaucacacgucacggcucuucgcccauuaacgcuuauagcaggauuauucccaaggaagcuguagccauuauauuugcugccaucacaacaguaaaauaaacaggugugacugcagcccuacuccucggguuguuucaugcugaucaguuguuaauauaugugugacuugaaguuggagccuguugggagaaaaaguugucuuuagaggaguaaaguguugccuugcugugggaaggggaaacuuuuucuugggaaguggacucaccaauaauuuuugcaucaugcgcaggagacccuacuaaaaccuaagugugcaaugcuuuaaaucaguaaguuuguuuuucauuaacauaaaauccaaaacaggugcugugaucagcaagccgcuguccuccaagugguaauucaggaacccaggcuccuuccauucuguggcuucaccuugaccaacgaagaccuuuugagguugccacauucuccaggccacuaacacuuaugucauuggcuacaacucagucacaugaccauggcugccugcaagggaggcugggaaauauaguuugcugugugcugggugggugggagggagcgucaacauuagugaacagccaggcagucgcugccucaaauuucuuuaguguuauccuuucaugccagcaauugaauuugauuugcacuguuucacuucucuacaaggguguaaaaaguagagguuccucuugaaagaauuuccuccccaucuaauuaggaauaaauaguaacuucucuuagaagcaaaguuaauucaaagaccugugcuaacauucuuaaauaucugcuagcuguaaugaagaaaucaauguacuuuauguucuuagcucccacaguuuagccuaaauauuugcccuggcaugcuuauacugguccaagcaagcauuaggucauagccuguuccucuuccuuauuugaagguguuuuuaccuuucucagcauuccacaaguuacuucguccuuccuuuguucuccucugccuuugccucuuuuuucuuuuuuuauuuuaauuuuuuuuuuuuaauuauacuuuaaguuuuaggguacaugugcacguugugcagguuaguuacauauguauacaugugccaugcuggugcgcugcacccacuaacucgucaucuagcauuagguauaucucccaaugcuaucccucccccuuccccccaccccaccacaguccccagagugugauauuccccuuccuguguccaugugaucucauuguucaguugucaccuaugagugagaauaugcguuguuugguguuuuguucuugcgauaguuuacugacagugaugauuuccaauuucauccaugucccuacaaaggacaugaacucauccuuuuuuauggcugcauaguauuccaugguguauaugugccagccaucccguuacuggguguauacccaaaggacuauaaaucuuucugcuauaaagacacaugcacacauauguuuauugcggcauuauucacaauagcaaagacuuggaaccaacccaaauguccaacagugguagacuggauuaagaaaauguggccuuugccucuuuuaaaaaguucuaaguugcuagccagucggaacaaauacagaaugugaggucccuuuccagccaauggaaaccggacacagcaguagaguacacgugucagguuauaaaugagccugucuccuuuguccgguguucucucauggcaaaacugcuggcgaguguacccuuucugcagaaaguaaaaauggccuugcugaggaaauuaaauuccuguucgagugcuauuucuuuauggcacugaggagcaagcauuucuaacaaucauauugcuuaagaaguggauggcaagaagauaauuacuaauaugucugcaaucgaucugaaauugacacaguugaucucacugauucauggggacccugggaguauguuuguguauuuggggguugggauggggggguggguggagggucagagagguggcaaaagcaggugggaacaggguuacagagcaaaguaauuagaugcccuuuagaugcucuuaguuaaagaccaugcaaaaaggaugaaaucuuuugaucauguucuucacaauauuagagguaaaacaugaacucaacgcuuuuaggaagaaacaacuggauugcguuuucuauuuuauugacagaaacuagauggggaggccaggguguguuuuauuauugcacacauacguaauuacaaagucuuugcuuuuuuccccuacauaaauuuauuuugagauuuaauuuccaccaauuagaacccgaaugaagccguuuuaaugugauuccugcaucccagcaacguggcccugcuucuuagugcgcacguaaagaaacaauccuggagugaauuuuaaguaccuaaaguuguguuagacugcaaaugaauauccaauucaauuuguaggaaacuuuagauuaauuagguuuauaauuugcacaguaagguaauguaaauguguugcuacggcuugacuuuuugcuuaauccucugaguggauauuuaaucuuuuuaauauuagaauuaaagcaacuuggaagauaugaauauuaaucuaauuauauuccgaucacuuuaauuucuuuaauguuuuaaauaacaaaacaacuuuacaaauugguuuagguuggggaacgcuuuuagaggauuuugcaucucaucaguaagugcaauuuagaggaugcaggcuugggaagcuguaccuuaaguuuauaguuaugcaaaugaaaaccauuaauccuggagccucugacuugcaaggugugcuucagaaauuugcagcuucuauuuagguaggaagaguuugccagcccgaaaacuccaguaagcaaacagcuuuauaguaccccagccauagaaagugagagcuuucgaagaaucugugguuagaacuaagaggauuuuucuuucuccuuuuucugcuguuauuaucucaaggagagagggaaaaaaaaaaucagagcaggacaugaacagugcuugcaaauuuuauuaccucauuauaauugauaccugcucucugagccaauaaaagaagcuauauucagcacuggcuguauaagaucuuuaauguuuuaggcugucaauguuggcugugguuaggcugacauaauuaugagcugcauguaccaauauauagcucuuuacccacaaaagcaugcugcaacggggaaucuuucagagauaauaaaaggauucaucaagugucuauacgauagcuacuuaaaucgcuauuguuuuaguuaggcccgcaaaacauaucccccagcuaucccgguuucuuaucuuucuuacuugauauuucaggaauuucaagcuuuuguacagcuuguucaguugcauccuagaggaggaaaaugcuuuuggcgugauuuccauuucaagaugacaacagggagaagucuuuccaaaaugcgcguguugcaauuucagauuuaaucaggggaauacauuaauuucuggaacuaauuacagauuuuaaaagagugaugggucugguacaguggcucacaccuguaaucuccacacuuggggcggucaaggugggaagaucccuugaguccaggaguucaggaccauccugggcaacauagugagaccuugucucuaugaaaaaaugaaaaauaauuagccaggcguggugucgugugucuguaaguccuagcuacucaggaaggugaggcgagaggauuguuugagcccaggagguggaggcugcugugaacugugaucacaccaccgcacuccagccuggaugaaagaguaugaccuuugucucaaaacaaacaaagaaaaaucauaaaagggaggcagaaaauuaacugaagaaauuguguuauaaaaggcaguguuuuaaguucuagaauuaaaagcaauugcagcaaauaccaagugagauuuucuguauuuugagaguuugugugugcaaugguuuuccacugacuaaucaggcugauaaaacaaccugaaaauggcuuucccauggaguuuauauauuucgucagagaccuaaaaugguauaaauguucaauaauagccagugaauauaaaacuaaauaauccauaugagacaaaacagguagaagaaaaaaacauuccuccucagauaugcaccuuuuaauugaauaaagcaaacaguaacagugauuaccaggacacuugcuguuuucuguuauuuugguuuauauugcuuaauuagccagccuuucuaauuaacauuacauuuugcugaguucacauugugauaaagaugaauaucaauucuuuucuacucaucucauugagagauagaguugaauucaucuucccuuguaucuaggcugcacuuauucguuugcuugaccaauggaauguggcugaguggccguguaaaaugccugacuacccugagacugccauguugaaggaagcccagcuagccauguggagaggccuuguggagcgggaaauggccaaccuccauccauuggaagucaucccauuugaggcccuagauacugaaaaucagaaagaaguuacuucccauuccccaccucaaggcccuguccaaacugaagauucaugggcagaauaaacaauugcuauuuuuuaaagguguauguuugggguuguuuccuacagagcaaugaauaaccagagcaaacacccaagggcaauaaauuaugaauagugaauuuaauuuuucuaugugaccuauggaaucagccuauuuuauggcaguacaaaguauauguagcaaccaaacaguuucuucuuuccuaaaacucaaagugagucagacuucuuaggcuuguagauguugaggacuaagcuuugcucuuuaucuucucuuuauggauuucccuuuggaagcagggauaagaagagggaaggucucccagauguaaauuucucauaaauauuugagcuccauuucaguaauucuuucauucucugaucuguugccuaaucuucuauuuagcaaguacuuuccaugaaauagaaggcuuuaauugauagaauuacuaauuugaauagcuuagcacagcucagcuuguaaaaaaaaaggaaaaccacuauccccauuaaauucucaucuuguaaaaccagccaucagcaccucccugucuuuuuacuaaaguuucccuucuuuggucuuuagugcuaaguaauaggcugucacuagaccaaaaaaaaaaaaaaaaaaauucagcauuucuuuucauuggagguuaccccagaacacuuaaacuuuggagaggaaaauagaaccccugaagaaaagugaauucucaugacaauuuguacauucuuugaagaaugacuguaauacauggaggaguuaccuuggacccaugugcagaguagugucgugaaugaggccugugccuuguccugugguuuaaggauagguaaauguaucuggggcagaggguugccugggacaaaggcauuauaagcuuauucauuuaacuugaguacaggguuucucaagcuuuggcacugccaacaugugggguuggauaauuuuuuguugggaucugcccugugcauuguaggauguuuagcagcaucccuggccucuacccacuagaugccaguagcaucccuucccccucuugucacaaacacaaaugucuccaaacauugccaaucccccuccauuaagggucaugucucuuggcugggauaagucuucucuaccguaucccuuuaacucaagaaguuuuucuugcuaaguuuaugugaucuugaaaauacggugagauugaacuugauuuucuuuaaaggacaaauaucugcuucuuccaaauugucauaggaauaguucaaagcuaaagagccuuucaggcaggcugggcacuucaaaccuacaaaacauagugcuaaaauuaaggaguguauagucguguguuuauagggacaggauauuuauuaucuaucacuuuugaaaaugucauuggcauuaucguucacuuuuacaaauacgaaggaaaaauaugaaggaguucuagaaaacaccagaagugauuuugccgccaugggccugaauugaagagcuuaacccacuaaucuguuaugacugcuuggggagugcuagcgcagguucucuaacacacugagagucguuuggaggguagugugaaguggcguuauaguucuccuuuuaaugguugagacaagaauugccuggaccucuuuuaggauacaucaccagucuuccaauggcaaacuuauguuuauuccagcugauucuccccagcaugggggcaugaauugcaguggaaaucaguggacuagaauuuggaugcaauugcccccaaauuaucgaagagaaaagaagaccacuguaauucaccggccauagcauuuuuaccaacuguuuuugcuaagcauuaguuucuugugauagguucaauucucaggcuccuucucauuagagucuuucuguaaagaccauuauuauuucuguuauauuuccuguggcugagcugagccgcacuuggagauuugauccauuuuaacucucucauugccuucagagaguuggugauuuuggggggggcaccagugugaguccuuugauccuugaaugacaauuuggauuugucucaagguccugauaaaugggaacuggaggaacuggccuacuaugguauuacaggcuagcacaugguuugcauucugagggagcucagaauaggcaagguagaagacauagguggucaagaauuuagaaagacccggacucgaaucccagcucugauccaucucagcucugccauauugccaaguuccgcugagacuccauuuacucaccuguuguaucaucugaauuauuuccauauccauaaugugcaaggauauccuuccauguuauuagaaauacagauacaccaucauuaucaguggccaaaucauucaaaucgcuguuugcuucuucucgggcucuuauucaagcucacgaugcuauucucauagugauugcgaaucucacugcauaaaggugauuuugaaaacaucacuuuuccuccacacuaaugugugagcuuagccagaguaggagauauaucuuacuuaaaaaaaaaaaaaacaaacaaacaaaaaaaaaaaacuccuucuucauuuguuauaguuccaggauagaguguguaccuguauagagagagucaggcagauacaggugugcccuccuuccaagaugugugauggugggcaacuuucuuugcaucucugagccucuauuuucucuauauaaaaugagagagaaaaaaauaauuccuagaucuagaguuggugugaggcuaaaauaagcugcuuuuaguaucacauuuggcaaguaguaaacucuggauaaauauacuuuugaauugugugauuauuguuguuaccauuuauugaaagggaaugaugaauguagugagagaaggaaggaagagagagagggaagaaggggaaaaagagggauggaaaggaggaaggaaggaaaggagggaggaggcaaguauauuagucaugauauagggaauugaaaagacauucacguuuuguggugaaugaaaauaacuugaccuuuaugaagcuggccuaaucccuggaaggaaaaaauuuccuuggauaugugauuuauauaaucaaucaacuaguccuuauuuugguagagcuaaacuucugucuuuggguuuacucaccguaucugugugcauccuggcaauguuuacgauauacuucuacuaaaauauuauuuuauucuauacuaacaaagggauuuguuguguguguaaaauucaaauuucaaugaagauuguguauuuuuauuugcuaacucuggaaaauguguuuacagaagaaccagagaaggacuuacuccucuccguacacuuuggacaugucaaaaucuagaaauagagaucaguaaagguaacacauagcaccuuaaaucugauuuaaaaggaaaacaaugacuauuauacagauuuauggcuucuugucaauaauacucugauuucuggagauuguuaucagucauaagcuuuauaggaaauaucuccuuuugaaaaugacauuuuaaauuaaugugaaauuguguuuuaauuuaauucacagggagucauaaacaggugggagaauuauggaacaauaauuguguuugcaagaaauggauuucauccuaaaacuccaugaauaugcuauuacaguuuguugucauccugaaaugcucuguuuaaccauaaaauacagcguaaaagacacccucauguugaaguccuuaaucuaguguguaauugcuuaagugagcacauuaacuauaucgucaacuaccuguucucaaacacuuuaacaaucagcucaccaauaugggugugaucuugacauugagauguagagcuugacaccugcauauaaaguagaaacucaacaguguuugagaauuugccauugcaucucagucuuuuuuauuuauauguuuuuucuuuuuuugagauggagucuugcccuguugcccuggcuggagugcaauggcgcgaucucggcucacugcagccuccgccuuccggguucaagugaugcuccugccucagccugccucccaaguagcugggauuauaggcgcaugccaccaugcccggcuaauuuuuuguauuuuuaguagagaugggguuucacuauguuggccaggcaucucaaucguuuuacuaagaaauuuggaggccuugagaaauggguaaacuugaaacauuuaaaaaaguuguucugcuaauuauccuaccacgugugucagagacaacauuacccucuuauuacuuaaaaguaauuuggacugguucgcacacacaaaaauagcuuuauuaacaacuugaguaauuuaucaaguucagauucuuuuuuuccuccagaaaugcugcuuuugguacacugagaggucauucauuuaaaguuuguccuuggcaauuccuuauugaauagauuccauuuuauuuuauuuacauuuuguacaaagcugauaaauaacugaaaccaaauuagcucaaacugguuauauuucuggguacaaaccagguguauaguuaauccauuguuguuucugugucaaccaccauuguccucaccuauacuugggcaguggggguggggaggagaacauaaaaacccaccaagccucauuuuucuugcuaauuuauuuccuugaacuuggugagauucuaucugcaguguuuccaaaaauaguuuuggaaauugcaaaaauacuacaaugcuguugugccggccacacugugagugcugacugucaugcauuuuauagcccaugucccucuccagugaggcuuuuggccacuggccguuaauugguaagguucuugaaaacugaagugaugguaucagcauggaugcccgugcuuucugaugccacugaagauggauagaagcuucaaguuaugcuuugugcagacugaauuuuuccaauuugugcuuaguagcaucuuauuauauuagaccagcacugacuggugaugaauagcaagauugcucccuucuaagggcuuggcaaaccaagaagaaugcagugacauaugucuuaugucuucaaaagcaacuggacacuugaagaguauuuucuagucucauuuuguaaacccaauuacgagcggagcuacaauuuuuaucuuuguuuaauguaaccaaugaggccauugucacuguauggagaauagcuuuaguccauauucucuguuuuuuaagacucucagucuccuugcaggugccuuuggagaguuagguguuugcugugauuugagggauaguggccaauaauuuuauugaaaugaauauugguuaauuaaagcuuauuguaugccaugggccauucuaagaacuuccauccacccaaaagcacuaugaaauagauguuguuauuucacugauggaaaaacaagcacagagaggcuaaggaauaugcugaagcuugcacagcuaguaaauggcagaacauucagacuggaauucagacuuauacacucacauucauaccacacagccucucgaagggacgugccccuugaacgcaagagagguacauuggguggccauggugcucacagucucucaauccuuuauguugagggagaaaugauaaccagaucucauuuugugugccaacccgaaagccugacuugacugccuaaaauguuaggaaggacucuaaagcccuaucuggauuccaaauuuaugguuggugcagacuggauuuuuacaauuugugcuuaguaguaucuuauuauauuagcccggcacugacuggugaugaauuacaagauuacucccgucuaagggcuuggcaaaccaagaagaaugcaguuccacgauccacuuggaaugugugcagugagugugggaggacugguauaaguagcaaagcacuuggcacucuggguguaaagcauucagaucucuugcaaaaugcaaauuuuaccugcggggauacccauucaacaauuagaagcugcugauuucuggacgagaguuaguuuauuuagaaaguaacacucagagacacugggacagagaacagauccauuuuaaggcugugugagcacugauccaugacaguauugguucaggggcaaagaaugggaggaaagaaaaagacaaguuauagcugcacugaaaacaaacugggcauguccuaauuuugcucagggcuacuucucuuagagucguuaagguuuugagcauauuaacagcaauacugaucauagcuaauaugccucuaugucaggcucuguacuggguucuuugaguauacucaccaccuccugacaagguuuuggcagccuuacuugguagacacuaugauucccauuacauacauggaauguacaguaacugaggaucacugugauauugggaaagugggacuucagacgcuagccuccccuuguagugccugcauucuuuucacagccccuccccaccuuagaaucauuuucuucaagggagaguaugguuugugaugcccuuaucagcaaaacuucagcuagaagaugcaagggugaaauacaccuccccaccccacgugaucucauagcacagaaugacuggccaccccagacugaagguuagggagacugggggccccagacucaagguuggggagacuggggagagggaaagcgaggaagaagcguaaguguaucuuacaguuuaaaaccauaaugggacauaucauuuucuuaguucuccauuuauuaauaaaaugcccaauaccuucuggcaugugcuuugaacugcuuuuaauuaucuucaguuggauggagaaaagguaauggggaccucauaauagucguggagggacaacugggauuuauuuccauagggaaggcagagacuguuugccagggaaccaaggccuuucaaaguugaggacacuucccggugccgugcgguguaaaucacagugcaaacuaugcgauuauccccugcagaggaaucgagugugacuuuaugggauucuucaccaagcacuuaggaauaaucugauauaaaacagcagggguggagaguaaugacaacuucaaauuaguuuaaugaauguuuacauuuaaaaaaaaaaggcuuuucugcaaaccugaaaauaagaagugacagcuuccuuuccuauuucccuugcaagagguaccuccugguuuucagccugaggaggaagguggcuuuauuuaacuccuucagccccggaacaucacagggcccuucuuugugcauucuggguucuaacagccccuugaacagugcuugagaguauuuccauuauaaaugucgaaucggcauugaaggaacaucuguuuuaagucaacuuagacucaauccaggaaaaaaaauaaauuucuggcuguccaccugcucaaaaggucaauuacccacccaaaucagccagagauggcugaugggcuacagaugccgaggauauuuuuagcaggauuuuggcagguacccugcuuguugaaugcagcaaagaagagggagguugauaaaccauuauacuguuugaaaguuggugccgcgccaaaucucccaccaaaucuggauggugcuuuugagcuauuuccccacuucugcugaagaaggauucauuucaguagaaggagugggauaggaaauguucacauugcuugcaguaugugaaauagaccucgagguauuuuggauaaaaaagcaacauucguguuuuagauaugguuacccagcccaagccgccucugcucuuuauagccguguuuuugaaguguucuuauuuuuuguuccgaaaucggaauauuuccuggcgugcguaucuuggccccaucacaucacaacaggcugaaugcuguccacagguugccagucuggauauggaauauuagucaaaacgauauaaacuaacuuggucucugcuauaggagggacaaaauaacuacaaaacaaaagcaagaaauaaaacaaaaccaaacaaaagccugcaguguuugggccccuuucagggauaucuggaaaaccaaauggagaauuccaggagcggauuuggaaacaagguugggucuacuuuggccuuuaagccaucacuagaaacacugacucuugcgcgcuagagugauguuuuuccuucucuuuuggauugacgugccagcaccucaagaaaccucugugaaaaauccacaggucuucaagaaccagaagaaaacagaauaaaaauagcucaaaauaaaaaugaaaaugaaaauagagcaaacauccauuucugugggaccuaaagaguugggaaaccuaaacaaccagaugaugauagcuguugcugcucuuccugaaaucaauuuuaaaguaggaauugucaaagauaaugagacuaguauggagcaaaaacuggcaauuuucaguuaaccagaauguugcaugaauuagaaccccagauuuuccuggagaugacucuagccaggccauuugaggacaaguugccaaauauuuguauuuuagaagccucagaagugugcacaauuuucuaguucucaacaaggcacuacagcaacaugucuaguguuuauguaaaugaucuuuauaaauccucuagcugauagagaguuuucuuccaucacaggcaaaauguggguuuagaugcaauuuguaauauuguuguacaagagugggguccuuucacugacauauacgaaguguuguaauacaaggcaaagaaaauacaaacccauccuuagucauuuagaaagacaaccugguugagaauuuaagaugaugguuuagggcauagcuuguggaauucgauggguugcacuguaaguuucaguuuccuuaucuguaaaaguaggaauaauaucuagaccuaaagguuauuuugaagauuaaaugagauaaugcgugaaaagugcugacucagcaccugcagaacccaugcgucgucaucaucacguuuguugagggauuugaggcgugucuaggaacgcagauguggagacaccuggagcaucuucaggagcuguuucugcggauucucauguggcuuaucaagcacaggaaauaguuuuccuggaaagacauggagcaaagcaguuauuuagccguccauccggcacugccaaccucuucguguuccugcaaggauuaaaugagagauggugacaguagagagucagcccugagggaggaguguacaauucaugggcuacuauuccaugugugugggucaggagacgcuuaaggcauucacagcacugggugugaggaaggaugcaaauaagcuuaacuuauuuaugaauuaucugcccuggaauggcauucuaauguuguguuggaagagagacaagaaugugcugggaggauacucaguuuauaacggacguucugauggccagugcaaauggcgccaggaaucuguguuuauagagauggagcauggaugccccugagcaccugugugugugcgaagggugaauggguugcugggaguucgucgguuguuuagggaagcacuuacguguaugccugugugugucucuaggacucacucuccacuucccaccuuacuuauuauuaguguucuuguuucucuucgcuauggggaaaugcagauaaaccguaaaaacuugauagagugaacaaaggcuucggaagcuuccuuaguucuuauaauugcucaauggguucuucuugccugcugcacagguaaaacccaguucacugagaugacauuauggcaggaaagaaagaguuuaauuaacacaaguccagccaagcaaaaggacaggaguuuauuauuacccaaaucagccuccccgaaaauuuggaggcuaguguucuuccaggauaguuuagcaggaagggagcuagggaauggaaaaugcugauugguuggggaugaaaucauugaaguguggaaaaugguccucgugcacugggucagccucaguuccaguugaaucacaagucccaggccuagguggggucagugggucaucaaaaugcaaaagucugaaaaccauuccaaaaaaaccagucuuagguucuacaauagugauguuaucuacaggaauaauuggggaaguuccaaaucuugugaccuccuaugccuacaucuuagcugaauucagaccccucuccuaauccuaaccuuguggccuuuuaggagcuuuacaaaggugguuucauuucgggaaaggcuguuaucauucuugcuuuaagauuaaaguauaaacuaaauucuucccaguguuacuuugcccuaugcccagggaugagugaggacugccagcccguggggcuagaagcaagauggagucagcuaugcugucauauuccucuuauggucacaauuucacaaagguggcuucauucucaugaccauugcucccaggcauuguucuugaauaccuuagaaaguuucauuagcucaugucucuccucuuuguaccaccuuccaacauuucccuacugccuuggacauuaaaguccaaauccagucuguucaucaugaucuguggagccuuugauaaucgcagccuccagcuucuccuucacaccugucuccugucuccugcuuuuucuuuuugugcacugcccaagaaccuuuucaucuacuaaucuuugaguuugccguccucucuuccuaaaucacuccccucccuccacuguuccacgugggacguuccuuccagagaggccucccuuaagcccaccuuccauaccuccucugguuauccucagucaugaggcccugcuuccucccgcacacugagcacaggcaguaccugcuuuacucauguacuuguuuauuaucugugucacccagugggacauaguagacuccaucagggcugggaaggaaucugccuucgucaccauuuugacaucauuaucaagugcgcaauuaggcucacaguugagcucaacauaggaucuguggaaggaaagaaggacagaaggaaggaagggggaagggaagaagggaggaagggagggaaggaaggagggaauaauuuccaggaagccucauuggauuucuuucccccuuauuucugaaagcucaccucuuuacagcuggcaaggccagcagaacugaacaauagagccggauuaagcaagcauucaggugcccacuuaauucaaucggcgaauuugcauuucucaggcucugugccaugagagccugccgccucaagggaccaccugccuucuaccagaaggacuuugcuccuuggagaauuucccucuggcaaugguccaggucaaacgagguaccauacaaauguggcuugucaccauuuuccaguuuaacuuucucaagccuuggcugccucgauuucauuccagacuacaguagcagcugaaaagguagcuaccauugcagucgaagacacuggcagaugggacuggcuuguuggcagagauggcagagauggcagagauaugaacuaucucugaaagggcauucugcaugccacaguuaagugcucuguugaaggacggcucuggaagggagcauccgcgaaaugaauaagaaggugguuauuagugaggucucccugaaaggagcauagcuggaugcaauccuuggaggcccugucuagggccugucuggggcuccagcuuucauagggccggccauccccuuugcucugggugagaucugucuuugcuucuggugauucugauauucacuaucgagaacgauugcuuuaaaacacaucagaucaaaguuuucuaaaaucagaguaaaagcuaaaaccuuugcaagguccugcaugacuugagucccuguuccucccuugacaucaaaauggcuguugucugcucucgcucucucucuuucucucucucugcuucagcuguccugaccuccuugaccuuucuuaaaaacuuuaugaaaacuccacguuugggcuucccuccaccugagaugcucuucucggcuccugugagggcuaccccuuuacccuuuauagugucugcccggacaucuccucacuagagaccuucccugaccacugccacauggaauaguacuaauacuucaugcucauccucugccugcccuggguuuuuaauuugugcgugugggugggguggggggcgggggggggcacuuaucaccaccugcauauuaugcuuuugugcauuucagguuggucuuucccgcaagaagguaaacucaucugcagcuguauucgcugugccuaugguagugccuggcaaaugcacagaaguggguauuacugaggacuuugugguucgaauggaaugagugugcugcugacaguguugcgagucaucugcaaaugaaaaguccuuccuucucuucccuucuggaaccuuccaaagaggcuagccuccugagagggcgucuccugggaaugccugugauccaggcaaggcaccuaaaucagccaauaaauaauuaguuuugagaaaaaagccugcacaaaagcagaacucacagauuuucucauugaucuuccugccuuugccuuggccauggucagucuuuggggcuauuagcugcauguacaagugcacaggggaugggaggggggcuccggaagaucccuaacccauuguggacacaccauuuauguuaguggaaucugguaagagugauugaggagagagcauugggugaaugacccuguaauccuuauaaaaauaguagcaacgguaacuaaugauguuuaugaacugccuaagaaugccaugacugugucaagcacuucccauaacuagcucauguaaagccuguaaccaucuugggggugaggacaauuaugucccauuguguuaugugucuguguuugcaggaguuguucagugguaaggugcagucaggacuuaaacccguguuccugagaguagcucugugcugccugacacacuccuuccuccugaaugcacaaucauauguucacgugccacaugguuuucagaaagcacugcacguguaggaagcucaagacagagacguggcuggucacgguggcucaugccuguaaucucaacgcuuugggaggcugaagcaggaggaucacuugagccuaggaguucgagaccugggcaacauggugagacccccaucucuacaaacaacaacaacaaaaaaaaaaauuagccaggcgugggggugcaugccugugcucccagccacucaggaggcugaggugggaggauggcucgagcccaggaggccaaggcugcagugagauaugaccucaccacugcccugcagccugagcuauagagccagaacuugucucaaaaaaacccaauaauaauaauaauaauaauaauaauaauaauaauaauaauaaagaaagcgagagaggagguagggaaugaaugccgaaagugguuccuugggucugaugcccacgcuuaaccgauucccagccaaacauuucacaguugucuuacgcacaggcguaagauaugcaucuaucuuggugugcaccugagaaguaguuaugucuaaguuuccgacuugacuugguagagucauuugaucaguaaagcgcagagcagaugaacuaccuggaaagaaagugccggaacuccccacgugugacaucucacuucggggaaaggugggcccugcgcugcgcuuggcgaagguaaaugcaccuggguauccucuugaccuggaaugguggaaaauaaagaaaacuucagcauguagcaaguaguugugaguacgauuaaugcuguuuagaguugccaguucucuuacgcacucagcgaaggccguguggcuucgcauuaaucaccaccaagccaacaugagcuuccagcaaaagagcccagugauugggaacaaauucaaaacagcuuuauuucauugacagacaggaccuuuuuguuaaacugugguuuaaagaccuuuacaucucugucuuguucacacguuacuguagucauuuacguaaacuuaggaacuaagaaccgacuuauuuaucacaaccuauuggcaggaaaagggucacauaaaaaagaaucuuuauugguagguuuuuuuuuuuuuuuaaagcuaauaaacagugcuaguggaaaguaugcuguuaucaaccauuauugaaguaaguggguuucuggacugaaaaaaaauaaagaaaacaucuaaaugucagugugcaaauagaaaguagcagucaauuaaaugaggcaguguguggucaccauagauggccaaugucuguguuauuagggaaagaagagaagccgggaaggaggaggagguuucugggguuaaccuguguuuugcuaacugguguuaguuagucucagauaagagcucuauguaaaccaacuuuggcccaaauugacucauugaaaaacaccuuguuucaaauuuuuucccccucuaugaccaaaaaguuacccaaaccuuugugucacauauuuaaggauguucaaggcaaccaauuaguauucaagcauuuagaauuauuuugaaacaucuucugugaaaaacaauuuauuuccuauuccaaaauaaaugcagaauauuccuaauauaguuugauaguuccuccucaagacuuaucauucaaagauugggcaaauugacuugaaagagaaaaguuaagcuauuucccuaauaccaaggcaaugcaggucagcugcagugccuaauguuuauaaaacuuguaaauguugaaacccacacuuggucugagagaacaucaugcuccaguuuguucuuaggaauguguuucugauguguguguguguguguguguguguguguguguguguguuuuccagaaaccaacugggaagggcccuaagcugagauuacuguugagaaguaaauugugcuuuuaaaguguccuccagcaaaauggucuccuggcugucuuuggaaaugacguaucaguccagaugcccuuuuucuugauggauugcuaggauuuuuacucaccaccgauggaaaauucucauagucuggaaggguggagcgucugccuucuaucaugauuguacacagaugagcaaagcuccuuggcaaugagugaggcagacgggcagucagguucggacuggugcagcagguaggcugcugcuagggaggaaggaagaggcacagaaguucagggcgugagaggguaugcgagagaugucaacaauccaggagcuggcuugcuucuuccuuuagucaguggugcaagcuucaaguggauaauucaaaugaaucaauggaaaggccucuuuuaacauuugauuuguuucuucaaagaacacagaugaaguuuuucucaucucuuuagauuagugauucuauauuggugagggaguggaagagaaauguggguguguugacuauauucuccacagaaacuuuuugaaguagcaucgucacucagcacagaacauuuugacaauacacuuccagggcaggugguuucuuacuaugucccucccuacccccacauacuuugggacucagaauguagggaguguacucucgagggaugcagcccauacgugaaugcauggaggcagcauauaagguugcaaagcacugaccuucucuuuuuaugauucccauuuauuccauagacugugaagucugccuguacauuuccaggcuagcaguuuuuaaucaaauguaugaucacuuucuucugaugaacacaguuaaggggcuuuguuguucaggugagucucacauuguacuccucuccuaagagcauuuauuauuacuugcuacauacauuuuugacaaccugacaaugacuuuuuugucuuaauuuggagaaaacauacucugagcuuuugaaguugguguacuuguuaaaggaagccagaaaagcuuuucaaccauuugagagggugugaaauacagaagggguugugcguuucuuccccccucaucucuuagagcccuguuacccaagagaguucaccaauuacccaaaccaaguuucauuuuguuuucucucuaguuugaaaacuguuuuuauugcuucaacucuccuugucuaggagagcuguuucagguuuuuagaguccuaagaaaggcuucacuggcucucugccagccuccugucccauuacacgcucaggcuuguagucaguuacucucugcugguuuugcuaaaccacucuugggucuuucuuggccuccugccccgcauuccccuucacguuguaaacguagcuuuuuaaguuggucccuugauugcuucaaguaauugaucuguuggccuaaaaaugaguggcucugauucagagguaggaguuaaaccagauucugccuagggacaaguguguugggagcucugcuucucuggagacaauggucagcaguguugcaaccaacuccaugucuggugcaccagauggucucauugggugguaggguggccaaaccuugugugagcuggcucacuuguucauucauucauucguuuacucguucuuuuuuguauuagcuuaaaaaugcuuauacgccggccaugguggcucaugccuguaauccuagcacuuuggaaggcagaggcgggaggauugcuugagucuaggaguuugagaccagcuuggccaaaacagugagacuccaucucuacaaaaaaagaaaaauaaauuaguuaggcaugguagagugugccuguaguccuagcuacucaggaagcugagaugggaggauugcuugagccuaggggguugaggcugcagugagcuaugaucauaccacugcaaucuagccugaguaacagaaugagacuguccccccaaccccccaaaaacagaaaacaguauuccuaucauaugcauucucaacucugcagagguccugggucacauuuccugcaaaguugcacugccucccauaggcaugagaccuccacauggacagaauuucaugaguguucaccuugguguugcuacuuugcaacauagacuugaagauucagagaggagaugugguaagaguuuauuucuggacagagaaaagcuacaccauucaucuagaucucauuaaucuguauucauuuugacaugcuuuucugcaguugacguuuuuauuuauuaagcgcuuuacaagauauucaguaucauuaucgaagcuauaauuauuaaugaucaaaguuagcaguacuuguuuuagcugucaucuucaucaucaccaucaccaucaccaucgucaucaucagggccacaacagccucuucuuuucucuuaaaucuuccagcaauucuucaacuuugccuguauauuuaucauacaacauaauccuaguauuuaguaaaugcuuggucuuugauuucuuauuuucaaaugcaugucuuuagaaccagaauguguguagcuguuuucuggccugaauuugggcugagaugaugagaaguuuaguugccacuuucagcuaaguggaaguguuuuccccauuuggacuccgggucauugacaaacgucaucacuguuuuuaguugaaaugugcuuccauguggcuguucaucagcacacccauaucuagacgugugcuagccucagugagaguugcagaaucuguguauucauuuccuuuaucuagaaauccucauuaugguacauaaaagagcuuucuaucgcuuuuuuacauuauaguaguuauucguuauuauuauuauuauuauuauuauuauuauuauuauuauuacugagacaccguuuuacucucucuuugcccaggcuggagugaaauggcacgaucgcagcucacugcgaccuccaccucuuggguucaagugguucuucugccucagcuuccugaguagcugggauuacaggugcacgccgccaugcccggcuacuuuuuguauuuuuaguggagacaggguuucaccauguuggccaggcuggucucaaacuccugaccucaggugauccacccaacucggccucccaaagugcugggguuucaagcaugagccaccgcgccuggcuuuguuauuauagaguuauauggauuuaucauuuuagguggagauuugaguuuaugucuccuacagacagccguagacuuuguuucauuuuaagaucaguguugcagacacugcugagugucuucaaaugucuguucucccuuuauuaccuacuaauaaaauaccuaauuuucaacagccugggaagagacuauauuucccugcuugccuuugcagcuagagugauccuuugaugaaguucuaguaaaugggacguuagcagaacugucguaucucagggcuuccguaggguuuauaacugauccacugagagauaaguugagagcuugagagucaaccuuuagaaaaguucguaacuauuugucaaaauuaagcuuaugucuguuccagguaguaauuuuaaaaugggcuuauauuuuguauguccuuuuuaauuuccuuuuucuagcaauucucaauguuuuuuuaaaaucucuucuggaggaggguacccuucacaaaguuauuugccaaaggucugaggaaaaaaaaagccuuucaccaugguuaguucgagaagcacagcaauacaguacuucugcuacgaguguauacaggcugaggaugggugcuuuguggcccuuuucuuuuaccggcugacuagaauguugacguuaaagcaguuagaguucgagcaggcaacuccgaccccaaguuggagcuguguguugaagauagaagagcaaauauguggaaggaaccuggauuucuauuuuuuuaaaaaauauaauaaaucauccagccccaaaugucaggaaccuggguuucuaaugaugguuggcugucacccccauuucccacacuuuaaaugagagaaguaaacaucugacuuccuaaaaccaccguugucacucaaagccgaaucucauccugacugaaaugucacuaguccuuuuuuuuuuuuuuuuuuuuuuuuuuuuuuuuuggucauauuuucuccauuuggagaggcuggcugacccaucaaugggcagugugggggaauggagagaccugggauuuuggggacaacagugaccaugaggggaucucuacacuccuacuuggaaauggaguagcauucuacacuuaaguaucucccuuuauaagcuaggaauacuaagaaccuaagagucuccaugaggauuagaugagguaauguuuguaaagaaucugagauauaguaaguugaucagcauauguuauuuauccucuucuucccucuacaaagauaacuaagcugagauagccuaacucccccagcucagaaaauagcaaguuauuugcaaaaucaaaugcugauguaaccauuuccauucugaacucagaaaauggagauaaaucucuugcaaggcuuuugauuuuaguuuuuagauacagaaccuuuaaaaaaaaagaaaaauaaacguuuugccaaaguguaguauauacaacagaugugagggaaggacauuguuuuaagugggaaacgucagcucucucaacuucuacacauucgacuauucccuacuccucagugaccccaaagaccccagagaaacucaguaugaaaaaucacuauggaagugcaauaguuauuacuuuguuuggaauucacuacaacacuguuucucaaaauauaauuccugagucacuuggaagauuacaaccaacugaauuagaaucucuggaaggcauccuaagagucugcauuuguaugaagcuucccaggugguucugcucagcccuaaguuugaaaacuacuggcagaauaguagcagaguuacuuauucuacauucguuuuuuaacccauuguaaaaaucauacauguauguucaagacaccggcagaucacaggaagggaaaaaaaaucacuuaugcuuccaccaccuuaaccuagaaaccuuuaggacuuuucaguacuuccuuucugucuuuuuccccuauaccuaaguuuuuauuuacaauauaguuguagccauaugauuguugcuuucauuguugcuuacauguguuaaauaauuuugucucuguauaauaacaaccucuggcgauuuuuccuuucucucucucucuuuuuuuuuuucuuuuguuuagacggagucuugcucugucacccaggcuggaguuuaguggcaugaucuuggcucacugcacccuccgccuucugggaucaagugauucuccugccuuagccuccugaguagcugggacuauagguguacaucaccacaccuggcuacuuuuuguauuuuuaguagagauggggucucaucuggugauuuuucaaguaagguaauggaagcaagagagguuuacauacaugguguacauauaccucggcagccuguuuccuucccuuauaacuaucucaaaaaaacauauuaaguuauuuuucagaauuauguuuuuuccuguugcuuuugacuguaaagggcagacuuaaauuuaguuaacaucugcucuaacguuggaucauguguggaguccccaguuuucaacauuaaaaauaaaguauuuguugaagugggguuuuuuucuucuuacaguauauguagaaccauuuucuugaaaauguuucuuagaaauuuguuacuuagaagauuugagccaaugauacauugccgagauuuguaagaguaagaccagccuacgcugaguauuauuuucucaaaggaauauuaugaggcacaucccaucuucauaucagggaacaaacugucacauuuuagugaaaucuguggguuaugugugaccacacacagugucguguuugcucccuuuacagaaaucuaaguaaaagaaucacuuuuuccuaguaucuggaugacuugauuucuuacuaucuugggccuucuuggaaacccugaaauguagccuuuucaucuuaauucacaaaguguucauucucacccuuuuccuucaugagaauuuucugaagcuauugugaaucuauggaagacucaagguaguaucuuuuucacagcauucaaaaaaaugcugcuggcuccuuggcuuguccggugcauccuccgugccagcccccgcuguccuagaaccaucuaagcuaacucuccgaugagcucuggccucuggaccucagccuauccaggccccuucaugacccagucacagugauucuaucuguaccuaccacagcuagguaggcgguaugggaagaccacaaacuugagagucagacggaucgaacuucgucuuuagccccccacuuagguguuaugugacuguggucggguuauugguaacaucuucuugcucagcuuccugaccugcagaaugggaauaagaauaccuagcacauaggguuauaaugaagaugaaacugcuuaacgcaugugaauaacaacaauggcuaacauguaucagacgcuugucuuaguguuuauuguuuuaugcguauuguccuguuucauccucaugcuuacccugagagaaaggugguauuauuauucuuauuuugcaggugaggcuuaaagaggucaauuauuagguugaacuguaugaaaugacuguuuuuauagggaaaaacaguagccgaucaucaauucccuaagguuccacguaauaauuuguccaggucucauagcaaaaagguggccggaugaggauuugaacccacugcucuccaaccccuaagcccgugcuuuguagaauuaaucggagcucuaaaguacuugacccugggccugacaccaaucaggagcuuaaaacccauuaguuucuuuuuuguuuuauuuuugcccacuauuaaaaugugccaaaguaauaagaucaaacagggccccugcguuuugacaaacauccgaauucugaauuucagcguggaacagggcauggaaagcaaacacaauggggaaaauugccguggccggucccgacaauguguggauuaaaaaaccacaugcaugcacagagaccugaugugaaugguauuucugaguggaagcuaaguaggagcugaaaauggccuuuuaaaauacagaacauaaggaugcaauucacagagauggucuaaacuguaaacaugcagcugugggguuugugaggcucauugcuuacauaccgacagcauacaaauugucaaguacuuaaaguuccauuguugcugaaagggccuccacccaauguccuuaaaugguccccccuuuuuuuuuuuuuucaaaccacaggauuuacaucucucguagcaucuaaugaaauaccagcaagaauuguguguugguguaagaaauaauaaucuuuccaaauccuuuuguuuuguuaucauuugcuaauagagaucuuugaaagaaaauucaaagauugaaguuuguauucuccuaaacuccugcaaagaaguccugugcaaggaucguucacuaguguucugcaucguucuucuuacucaacucucccgagaggcauuguggacgccugugggguugguuuuuggcacccaucccugaccccuucuucuccaggaaacucuguuccuaccugcuccucuuguggcuaccuugggaggugccauuuuuaucaagguuagugugugguuaagcaccuucccacaagcucaggggaaaaaaagguccccuccccagauuuuuuuuagaacuggaaguuuccauuuccuggcacuggugaaagcucuaggacauaaaacuugggagccgauggccuucaggcugcccauaaugugaagagaggucauuucagacauucagauaaagucuguggcuccaguauuuuucuaggucuugcucccucccugaccuuuucacaguuuggugacacaacucuuccuugaauuccauagguugacaaauuccccugaguuuggguuaggguuuuguuacuugcaaggcaggcaucacagggcugcuccuggccaugcauagcuuuggaaucacuucucugauucucauggcucgggaaggagaaaguguccuguguguggagauggcaggguggcuggaguugagaggagagucccuugaaugccacgcaacauuucucucuguagguguccucugcacacuguccaaacuccauuuuuaaccuugacugcauaguaccguguacauucauuaagcaucccucgccauaggagaaucugaguuccugggagcauuuaacacaguuccuggccuugaguaaaaacuucauaagcacuuguugaauugaacugaauuuguugucuguguuuaaaggacuugauggauaaagggagauuuaacaguuuauagccagauuggacucaaccaugaugauuucugguccaucuuuuagaaugucuucacuucucuuggccuuuauuucuccaaguggugauaaugagaccuaucccuaacgguuaaagugacaugguccauuuaaagugcuuaaaccaauugccaggcacauaauaggugcucaauaaauacuuccuuuauuucccuguuaggccucucccaaccagagaucaaagaugauuggcccugaaguuauuuuuccccccaaauuugauagaaaucaguagagaugcuaaaauauaauacauuugaccugcauugaucaagguaggcuaacugcuauaacaacuuuacaauuagugccuuaacauaauauaaaaugacuucuuguucauguaacauccaagguagcuguaccuaguugcaaugcucucuuccaaguagauauuuagggacacgggcuccuucuaucuucugucaccaccaccuuuauuuuuagcauccgcggucuuagcaacaguagaaggaaagaauggagauaagacaguggguauuuaaucaccuuagcccauaagugacucacgucacuucugacuaccauauccaauuuuugccucucuuuuuuucuuggguuccccccgacaaaaaaaaauaugacagaagugucacccauccagccagccagccaucaauccgguauccauucauccauccauccaucuaggcaucccaggugacucauuccugugaccuugggagacagucuuucuuccuagagguuguuugccccaacccccuguuacauucuugaaccauauguuucccauuguuugcacuuccccuagucaccuggugcuuuaauuuuugccuguaaccuucugaaacuuuccuuaaauguucggcuuugaccugucauucacuaagucuuucaccauccuucacucaucuuaccuccuucuucuguggcauuucauaaauuuaaugauuguaauugugauuacaacauaauuguuuaugucuaccccaggcuuugcaacagggaacuauaucauuauuuugcagacacaacaaauucugcaagcauguaucuuuggaauaaaggagagaggguuggacacaaaugugauuacaacauaugcuucucugggcauagcuuugccccauugcacgaauauagaaaauuuggcaggcugaaaauaagcggaaagauccucaagcuguuccuuccacccccugggaugcugauuaagauuucagauuuuauuuauucuacggguauuuguugaauauuuauuucuuacgauaccacgcacugcuuuaggcacugggaauauagcaggauauacaaaacagaaaaaucauggcccucauggauuauugguugugaguaauaggaaccuuucaaucuaacuuaggaaaaaagguuagggagccaaggaggaagagugggugugaugaugcaucaggauaccagagaaucccguggaaucccacagugacacagccaagccuugggaggggugacacuagcgauagagacagaaacccacacaggaguccuuuucucugucucucaucucugcuuuucucuguacaucugguucaauuauucucuugccacgaaucagcuauuuguauuccucugugcacgucgcagaagaucaggaauuugcacauuauagucacaaccauaccuagaaccaaauugccuaacacugaaucccaaauccaaauuccugggagauagaauucaauucuucucuugccacaaaucagcuguuuauacuccucuuugcacguugcagaagaucaggaauuugcacauuauagccacaaccauacccagaaccagauugucuaacacugaaucucgaauccaaauuccuggauuuggauggacucaaucuggacccaguaucuacauuugguccagucaucuguauccggcaucggggucuuguugaaaaaccauggcuuagccggguacaguggcucauaccuguaaucccagccacuugggaggcugaagugggaggaucgcuugaagccaggaguuugagaccagcccgggcaacacagggaggcaacaucucuaaaagaauuuuuuaaggaauaaaaaggaaaagcauggcuuuuauucuaagagcaaaggcauuuuguauauuuggcagguaucccaacagaugcaucacccagucucuuaaauuaagauaauaauuuauuuggcaagugaauucuucuaguguaguuagauagugaugaaaagauuuuuauaccuccaaacacacacacgcacaugcacacccaccaggcucuucuuuacuucucacucauagauuugaaaacaacuauuauauuauagaaguuuuuugguauagcugccaggggucauuguuuccauccccuguguggagauaagaaaaucgagauccaguggaguguggggugcugagagaacaagucuauguuuucuugagacaaagucuugaucuguugcccaggcucgagugcaguggcagcaucuuggcucacugcaacuucugccucccguguucaagugauucuccugucucagccuccuagggagcugggauuacaggugugcaccacuaugcccagcuaauuuuuauauuuucaguagagaugggguuuugccguguuggccaggcuggucuugaauucuugaccucaggugauccauccacuuuggccucccaaagcgcugggauuacaggcaugagccuaacuauccucauuaagccaucugcuuucugcagucauuuucauggcgauguguuauaacaggacagaccuuguacuuuggaaucaaacauucucaacucugcuaucugcucuuuguggggcccugaacaaaaaucuuuacucucuuugagccuucgcuuccucauuggucaagacuuuucucacugcauuauauuugagugagacccguaucaauggauugaaauucucagaaacccaagaccaggaauagcccagugacaggaauuuagaccaugccaagugugaaccauggcuugcgggggcuccugucucacgcuggaugcuccugccuggcugccucuggucuccagcagaagaccugucgugcuugagugacaaagcagauugcuuccucccaccucuguggguuaggaccccuuuuucuauccuaguuucacucugaugggcgaguucacucacagugaaaccguagcaaaaccucaagguuuggcuuaacugcaaaggggugguugauaucagauucauacgccagaaccagaagaccacucgugagaaauucuguaagcacaggagugugguuuaugucaaaaucaaucugauggagugaagccauuccuugccaagcgaaaauacagcaucaucaacuacauccuugagccuagaaccucuucacucagcaccagcuaguggguaaagcccgggagagguuguaacaaaucugauucccugacacucaccugaaacaagauucagcaaaauuaaaagcaauauuaauauaugucgccuugggaaacagaggcagaggagaacaggaaagagucagauggacuuugauuugagacccguuucugcuucuucccagggugugaccucagcggaguuccagagcauccaucuccuuuguaagacacagauaauaccaacugcauggauuuguuaugagaguuacaucaggggagggucaugaggucaccuucccauggccaggagaagcagguacucaggaauggcuacuucucuggccacuuuauagaccuauggagauguugaaaguagcccaaaggaacugugugccucgcaucuugguccaucuucauggguugaucauugugguucauaucacuguuucaugaaacacagcccgccagaaagucgcgaguguuuugauuucauccuauaccuauaguuacaggccauuuaagauccacagucugcucuuuuagcuucugccagcacauuuggacaucugugcaguucccagggcaggugaagaguuguucaugugaugcaaacuuuugagaagggacguguagggaagaugggagggaggugauauuuauugaguauuuucuuuuugcuuucagcuuuauaccuugugugugcuuacagaggucaugaauuguccgcuguuguauguguaauccguggcagaugugcauaauaaguucaggaggggcucgguuuugggaggccggggauacuagaagauaacccuaaaauguggaaaucuacaucagagaguggugugagugguucccaaaaugccuaccuggcacuccuaccaaagacacagcagagaacuuggggccucuuguuucagccauuuucaucuucacuguaaaucuagacaagauaaugaaugaagaaccugacacauuuaaggaacuccauaguugggagcccagugugagucauuauggcgagucccuaacacugcgguuccccuacuugagggcgcagguaggggcacuuugcugccuccuuugacaauaagcauugccauugccaugugauuugcuuugccuaaugaaaugugagugacacuuccagauggaaauauuaagagccagugugugguucacccugaccccuuccuaugccccagcaauuaaggaagcaauguucagaugaaacccaugucuuccuccugggucccugagugaccacagucaacagagcuucccuguuggccauuacuaaugucaagaacaaagcuguguaaagucacuaagauuuuggagguaucggcuguugcaguagaaccuagccuaucucaccugacacaaacguuuucuuucucacaaaaccucacaccaguguuguuuuauucaucugcuuaugcacgcguauggcugcaacauccuuccaaaaugcauuacaggcucuaaugcacgauaagacaguuagguucgaaggaaaacaaagacaauugcacggcacagagggaauauacugcuacgguaaaccgaucacuaacacccggcccugaauuugcuucaaaguuuucacuaaggcacaaagggagccguguggagcuccggaguucccaucugaggucuugucuaacuccuuggcaacuuuuauguauuuguauaggagacucuuuugccagaugguugaaauguucauccuccuauuuuguuuuaaugcaaacugacauuucuucaucuuccugcgguggguuucuuuuaugaggucgugcuuugcauuuucauagaaagaauuucugacucccgaucggagcccacccuuguaguuucugugggggcuguuuugguuaaccacucgcaucaguuuuaagucuccacaggcagaaccagaccaucgugaacuucuugauuuacauggugguggagaguggcugagaaaccagggagaaacaggaaggagcugauugaggagaccaaaggaggguggggccgcagcucucaggcacucuugguguucagaaggccagcuugaagaaagaugugcauauuugcaaaugcauuucuuguuccuagugaagaggugaggaaggacacugacugugcuagagcuguacaaagagaaguagaacucuaaauagagaaaauauguaaagaucaauaaaucacaccaaaaauaagucauaagaacaacaaauaauaccaggaauaaauaauguaaaauauaaauaauuccuaaaauggugauaacagcuuaugacaaguaauuucuuuuuuuugagauggagucucgcucuguugcccaggguagagugcagugguacagucucggcucacugcaaccucugcaacccagguucagucgauucuccugccuccugaguagcugggacuacaggugcaugccaccacgcccggcuacuuuuuguauuuucaguaaagaugggguuucaccauauuggucagacuggucuuggacuccuggccucgugaugcacccgcaucggccucccaaagugcugggauuacaggcaugagccaccgcaccuggaggacaaguaauuucuaaguauuauuucuuuuaauccucacagugacuccuuguuaggguuugcugcauuuuauacaaagaagaaaggagucuguggaagugacauaaaguaggacauguauucauuuacugauucaaccuuucauuuguacauauauguauauuuuacagacacggucacccugucuagguauuaacaguuauuacaaagaugauauaauuuugcaaucaaaauacagacacaguugucugucucccaggcuggagugcaguggcacaauuauagcucaccacagccuugaacuacuaggcuuaagcaauccucccgccucagccucccaaagugcugggauuacaggcaugagucgccacacucaauuauacacuuaaauauacauauauauauacaauauacauauguaaauauaucugcauauacauguuuagggacaaaaacacgggaguaccauuucugucuuugucucucucucucuuucucucacuugacucuguugggagcuauauuaguuguuuucucuuuccaaaccaccuucuggaggucucuuagauuuucccaaugaugaaggagcuacugucuagguuauuacaguaguaauaguggccaagaaaaugauaugagguugaaguggacagaugaugcuuuucacucuucugggagguucccacuggguggucugcuuugcugagcuuugaaaaagagcuuuucuucuucccaguucacugggccgaugugggcacagccucagguuuugguuuuuuucuccuuugcuccuucaccaccuagaaaacuaauuuccuauaaagaaaauuucucuggaaaugcaacuuucucaauagguugagucuacucaaagacugacagguaaaagugguccacauagaaaaaccuguuucucuauuuuguuuucaaaauuauaucaucuuuauaauaacuguuaguaccuagaaaaaugcauacauuuuauuccuuaccaaaaccaguuacccuauagucaaaaggcauucagaaguauuagcagaaauguagucaguagccaggcauaguggcucacaccuguaaucccagcacuugcggaagcugagacuggaggaucacuugaggccaggaguucaaguccagccugggcaacacagugagaccucaucacuacaaaaaauaaaaacaaaaaaauuagccaggcuuggugguacaugccuguagucccagcuacucaccuguagucccagcuacuugggaggcugaggcaggaggaucgcuugcauccaggagguugaggcugcagugagccaugacuguggcacugcacuucaacgugggcaacagugugagaccccaucuccaaaaaaaagagcaguauagucaguaagaaagaaaacaaacuaacagucaauauuguggcugcucucaauguucuuuaaacggaucacauugccacuuuuuucucuuuguaaaaaugaaaauucccagcacauauuacaugcucaauaaauguuaauugagcauuuucugucugagaaguucaggcaacuuuucauccuuccaauuguuaaguucuaguuucuuauuacaaauuauuacuguuauuauuuuaauuugauugauaugcaaaagucaaauuugugcaaagaaaaugcaagcuuugagaugagaaagcgugucuucugguauguuucuugauacauuuugaggguauugagcucuaauuuacuuaagaugaccuuuugaaaauagauuaacuuaucaaaacuugugguggaagcaagacuuugucaguacaguacuauccaaauucuaaaguaaugaaugcuucucucccucuggaguuagagaccugacucugggguguggauaaagaauuuguguccuggccaggugcaguggcucaugccuguaauuccaacacuuugggaggccaaggugggaaaaucacuagaguccaggaguuugagaccugcuugggcaacauagggagacucugucucuacaaaaaauaaaaagaaauuagccaggcauggugcugcaugccuguaguccuagcuauguaggaggcuaaggcaggaggacugcuucacgcugggaggugaaggaugcagugaacugugauugugccacugcgcuccagccugggugacagagugagacccugucccaaaacaaaauaaaacaaagaguuuauguguucaguaagagcugcagucacaucucuaguacagacucugcagagcacuaggaagccccgugucugaaugggauauggugagagaggcagccuagggaauggagauaccuggggguccccaucugcuccugauggacagcucagaugaccccaagacccucuaccaggcacugauggaguaaggauggagaugggaauugcauuuuagagguaagaagccaaguggcaugaugaggagaguauucaugaaauuuauggaacagucugggggaaaugccaugauuucaagcccuucaccuaaaucuucaaaaguggcauggaucagugccucucuuccccagccaggagcgugugaagcauggggaccuccggaauguucucagaaaaugcuugguucuuccuguguugagcagggaagaagcugaagcuagcaugggcaggggagaagaaagccaguuacauaucaaagaaugcuuaucuccguagacaccacuguguuugagagucacauugggugguuuguaggcagcuuuucauuuucacagccagucaggcaaggcuuggaauaacuugucuaagaauccucaucuuaacccugugcuagaacaacaagcuuggaaggagccagccaacaggagaaagccagagcaagacucugugcuggacaagaaguccugagcacuggggaguugacuucauauuggaggcagagaagaauuaccugccgauggcuguuggcccauggcaacacccuagaucguugcauuugugguccugcugaaagaggagacuuaaguuauagaguuauugguacuugcaacacuuucucuggaauuuggccauuucucugcucuuuuaguuuaguacguucucuugguugcgaggaaaucacugaagccaccucacguaaugugagcauguaugcucaaggggaccaggaaaugcugaaaguucaggccucggaaaggacaggauguggaaggauguucuggacucaaggaggccuagggacccuuggcaggaggcauucaugggucuguaguccaaggcuccacuaccaucuccuuggcuucucucuuccauucuagcuucuucugcuuauucaucacuuuugcuuccuaugaaauuggugcauccuggucuuggccucuuugagcccucuguauagugugagcucaucugguacucuugacucucucaggcuccugaaggagaaccaucagauagaagcaucucaucuccccaggccaugccacugggccucagccaggcuugaacuagcuaggcucaguccacgggguggccuucaagcagccuagacuuggaucccuaagcacagccuguggaugggacguuuuaagguaaagggaggacgcagagcauugcagcccguugguuguuuucuccagcacagccaugcaaaauccauguagcggcaggaauuuugcagcuggaguugcuccccugagacucugaucagauaaagacaggguuugcugaacaccguaggucuggcccugagccgugggcagccugaugagcacaggugaauggugcaagggauaaccucacagucaucagcaagucuuaucugggccgcugcaaauaugacggagucagaaaaaugacaacauaaagaaaugcgauguuuucuauggggguuucuuuuugaaacuaaaagagguuuucuagacucacuccauggagaccacuuuacuuuccauuuuucucagaugauaacaucugcaggggggcuccuucuguggguacaucauuugucaaauaugugguccauauugagaaccgcauaauacuuauuaauuaccacaguugcuacuuaccgugggcugcuaagacugcuuuagauauacugcagauauucaaagagaauucaucguccacccaacggcaaaguccauagaagcccaggaugcauucugacccucauccuuuaaagcuuacugaacauauugaucaccucuuuuccaaaggauacuuccuauuggaguguacuuuuaaaaucuauuuuuuuugucuuaauguuuaguguaaugagggaguauaggaugaacucaauguaccuugaacauagcuguugucaggaaugaagccaauuucauuuugccugaauuagggcccuuuggugucuuuucuguaugcaguuaauacaguucgugugcuguaccaagggugcgaaugugacuuuucaucaggaaggccgcauauggugggcacagggccuagcucugccguuuuauagcugcauaacugguuucuugaccuuuuaugagucucuacucauguuuuauauggagacauuagucaucucacaagauuuuuguaaugauuagaauauuuguaaaguuccuggcaaagguuugauuauaaauuagcgucaucaugaacguucaagguggggaccuuuuuuuuuuuuuuuugaggcagagucuagcucugucgcccaggcuggaaugcaguggcaugaucucggcucacugcaaccuccuccuccuggguucaagcgauucuucugccucagccucccgaguagcugggacuacaggcacacgccaccacgccuggcuaauuuuuguauuuuuaauacagacaggguuucuccauauuggucaggguggucucgaacuccugaccucaugaucugcccgccucaaagucccaacgugcugggauuacaggcaugagccaccacgcccugcuaagguggcaaucuuuauacauaaaaaacaggaaugacuucuucgaauuggugcacuagagaaauguuuuccagucgccuaagcguuuaagcaugguaaacagauuaccauauuaguugcccagaccuugcaaaacuucauaguguuuguuuguuucccuugggaggcuguucugagaaggaaccuuuucauuccucggaguucugauguguucauuggccccuguugucaugcuggauaugggggcgguucaaggggggcuugggugccugagaaaaagagugaaaaacccaacugcgaaaacccaagagaaaccgaaagagugaacacuggaaaaaaaaaaaagggggggccggcgagcuucaggaccuaagcgguuaaggaacuggcuuugacaggaagugggcaggaggcuguuuucaguaugcucaugggaacccagcuggaaagugcuguggugaguguguguggaaaaaaggggcuuuaaucaagcuauaaauaucuguuucuuugaaguuuuaugaccaacaauuaauguuacuggaaggcccauaaaaagggcuguuucuugacuuggugggucugagugggccagggucggguuaagaugcuagccucguggggugccauccugacagauucuacugugugcgugugugugugugugugugugugugugugugugugugugauauaauguguugcauuggugucuaaagccaugcucaguauauaguuauauauuucauucauucauccguucauucaguuaucucacguuucuggagggcccucuaugugcaauaccuagugauacagcagugaacaaaggaaaucccugcccucagggagcuuucauucuacuuggggaaagagacgugaaagaaaucaagacaugcaagcaaggauaagugcuguaaagauaauucauuccuguuuagagggcugaggacaggaagacgaugcuguauggcucuagacaggguucugugaugaguggccuguggacagauuccuguccgaagaggugcagggugcaagggaggaggggacggcaaguaucaaggucccgagugaggcacaugcucggcggggcccaggcaugccaccaaggccaggaggagagacugaggaggcuuggccaugcccugccuuguugguuuuuagaaagacucuguuuugguuauuuuguuuuucuuuuuuugagacaucuggagugcagcggcaugaucucagcucacugcaaccuuugccuccuggguucaaacaauuguccugccucagccucccaagaaguugggacuacaggcauucaugccaccgcacccagcucaaauuuuuguauuuuuuguagauaccauguuggccagccuggucucaaccuccugaccucaggugauccacccacaucggccucccaaaguacugggauuauaggcacaagccaccgcuccaggccuagaaagacuggauuuuacccugauugagcgagggaggcucucgagguuuuauuugguucugcccagugaccagccaccauaaccacauccuucccccagacuuuuuccucuuccuauaaaacaaaacaaacaaugugaacaacaaaagcaaaaacaaaaaacuaaguaguaguuggggcauuuuuauuuuaaugcugcuuuuuuuuuucucaccuuuugcuauaugcugaucccagugcaugaaauuuuuuuguaaucucauuccuguguugaagcucuuucacugcuuucgugagcacagaugaauuugaaggcugccaggcaguagcaacauauaccagcuuccccacuggguguucauucuacccaauuuuuguucauguggacuucaggaaucugggauuuaugaucuucggauuuggcucuuggcuugaggcuuagccugugcagucaucuuggagagaggguuuacuaagcaaagaacaccccagaacaaucugggggaacugugcccuuugcaagagagcaguuuuaaaguacccucgggcaauuuagaagcuccuacugacucaaggauauucuuaccucuucguuaaagcagcucgccuaaggacuuugcuagauaaaaguugguuuucucaagaggguuucugcacacacccgaccgcaucuuuuucuuuucuuuucuuuguuuuuuuuuuuuuuuuuuuugagacggagucuagcucugucaccaggcuggagagcagugguauuaucugggcucacugcaaccuccacuuccuggguucaagugauucuccugccucagccuccugaguagcugggaccacaggugcaugccaccacgcccagcuaauuuuuguauuuuuaguagagacggaguuucaccauguuggccaagauggucucgaucucuugaccucgugaucuuuucucgccucggccucccaaagugcugggauuacaggugugagccaccgcaccgggccucacguuuuucuuuuaaagaaauguguaauucagaucagucuugcuuucagguagucugaauuaggggaguuugccugugugcaagagaaggcuuccuacuucauuuucuugugugcagggagccauuuaugacuaauaggauucauuacauguguguuuagcccaccgauuauuaaggcuuuaacaauauuaaaaccuaaagagauaacagaggggaagccuuugggagcuaggaaucaaucgugcuggguggcuugaaaacagggcaguaaaauggcagccgccuagccuguggucuuuaauauuaauaaagccagaggcgauaucacuuaguuguuccaacaugauugguuccucauggaugugcacccuugcucaucaccaucucaccaccaggcugacccuauacaucuuccaggagcccagcucuuuccccuggaaaugguucucugaguuucagcugcaguucagggaaaaggccagcagccacguuccuuguuuuguguaauuggucuuuagccugaucugauucaucuggcgaaaccccuuuuuccaguaaaagucguuggcgaggagugaauugugauggaaacagagacagauguauguaccuuucauggacauaauuuccccaagacugaacacaaaaaugaggguuuuuggagaucucucuggaauuaauguaaacguuguugaaaacauauuauucuauggcuccuucauaaacccuaggccaucccgaggcugucucacucaggccccucagcccucauaaccccccagcuccauaggaguggaguuuggauuucaacuagauaaggcccauuuucauggauggacaugugaguuuucaucuauaauauagaaugcuauuuucuaguuagguuggagcaaaaguaaucgcgguuuucaccauuauauucaauagcaaaaaccgcaauuacuuuugcaccacuacuuuuuaccuagcaguucaacagcuguaaagaaagaugcugagcuguugguuacguaacugugguacagccauuucauagacaagucuacaucaaugaaaagaaugacacuucuaaaggaaaaaaaaugggcaaaaauuauguguuuacaucuaucagaaaaacaaaacaaaugucacggugugguugggaggagguggggagagaggcagauuuuggaggcgaaagauacacagaaacacuaaauaccugucuauuaauacugacaguaguugcguuuaggggaugagacucuaaauuuguuuauuuaaauuuucucauuuuaaaaaaugaguccuuucaauuaugagaucaaaaagaaauguucaguggcuuauugugacccaacauuuuucuguuugauuuagauagagcuuuuauuugccuaaaaauugugcuugcaauauauaugaugauuuuuuuuucuuuuauuaaaugaaaaagagucauuuaacagucacaguggcucagccaccacccgcagcaggcagugggcccacuucaccuucccagcaggccuccagugcccggugcaggguggcccauuggcacccacaacaaacaucacgacauuacuuuuaccgcacacuuccugucgaggcacaggcagugcuucagccuuuuugguaacuugaaugaacaucaaaaggauaaucagauauuaguuaaacuuguuccucuucuccaaucauugauacuuuucucucuugcuuccccucccccugcccuucgacacagagugacaggccugaaguaaaaagggaaaaggggaaccgagugacucagcccagagugggccucaccgcagcuuccuggccacuuucucgcucucuccuuccaagagagaaaggggaggaagcccagagccuucuaucacuuaguaccgugucauauaccacuuccacaaaugcuagggaaugaacgaauacauguaugaaugaaugaauguccauggggucacucagaaguaguggcauaauuuagccagauaaagugcccaccuagcacucaucccaccuccucacuccucuauccugugaaugcagaaauacaauuccucauuuacaaacaacugugcauguaggguugcuugcaaaaguucgucgugugccgauauuucauuaccacuuuugccagcgcucucgucugcauuuccugagguuuuucuuuuuuuuuuuuuuuucuuuuuuucuuugauacggggucucgcucugucucccaggcuggagugcaauggcacgaucucggcucgcugcaaacuccaacugguucaagcaauuccccugccuuagccucccagguaguugggauuacaggcgcccgccaccauguccagcuaauuuuuuuguauuuuuaguggagacuggguuucaccauguuggccaaacugguccagaacuccugaccucaggcagucugcccaccucggccucccaaagugcugggaugacgggugugagccaccgcaccaggccauuuccucaguuuuaaaaagcaaauaagaaacaacaacaaacugcaucagaguaaccguuucaaaaacccaucucaggucuguuuuuucuuuuuuuuuuaaguuagcauuuucuagaaguuuugguauaaaauauguacaaggauacauauauaaacuuagugaccaucugaagauaaaccuggaaugaggaauaacaaccucucauuuaaaggaguuuuaaagagacaagagggaggaaacgagaagagaaugacaguguuucuuucauuaaaaggagcccaauauuuauugagccaacagguuuacacugugucuaccccagagugucaucagcccaaaccagaucagcgucgugggcgauuuuuuucacuuuacugcugaggggauuugccaaucgccuggucagcuucugaauucuucgggcacacaggaggggcgacaugguucuggcuuauuucuaagucccuuugaggugauuucugguccacaaauugaggcaaaauaauccucacaauuucuuggauauucucugccccagccccguucuauugcaaaggaggcuucucuaaaaggcuucccaaugccuuagaaucuacuuaaggguauuuuugcuggagaaagagcugcugucuuuguccaccugucguuuuccuuucuaccccaacagggcuuucucccucuggcuguuuuauuuagcgggagaagacagaagagauggaaaaauggacccugcauuuauagcuguuccuucaaggagcucaaacugcuuucaggcauuuccuuauuaccucauuaauccucauaauggucccuuggcagaauuauucuuauuuucagaauggagaaauugaggcacggacaaaauaaauggcagguggaaggucagagagccaggcagcagaagaggugggggcagcaggauggcuucugguuucugcccugguccaucagucagaauguccucuucagaugaggagaugcagggugaggcgcgggggagcugacauugcauaaauaauaaaacaaauggagccacauuuaguuaucacucaucuagcggaagucgaucuucuugggacaugaguaggcucuaaccuggcagguuuuucaacauggaaccauuauuugucacauguguucugugugccagggacugaguucuucucaacggaguuuacaugugagaggagcaagggacaaaccucacaaauaggaauacagaccucagaaagccgacuucacccuugcauacuccuccagguugcccucgccucccgccuggaucacugcucaauucucucucucucuuuuuuuuuuuuuuuuuuuuuuaagacagagucuugcucuguuguuuaggcaugaucuagcucacugcaaccucugccucccagguucaagugauuuucccaccucagccucccuaguagcugggacuacaggcaugcgcugccacacccggauaauuuuuuuuuuuuuuuuuuuuuugguauuuuugguaaagaugggguuucaccauguugucaaggcuggucuaaaacuccugaccucaacugauccgccugccucggucucccaaagugcugggauuacaggcaugagccacagagccugaccacaguccuuucuuuuaagggccuccuggcacccagccauguugggacccuuucaguucuuucuccacggagaaccagaaucuccuuugaaaauauguuagaucaccucuuucuccugcuccgaacuuucugaaggcguccccuguuacucggagugcaagccaugcucucgagcuggccauggcauccugcguccucucccuucccccauuggcucuguucuuccugccagugcucuucccccugcucacuggguuccagcugugcgggccucccugcuguucaauggaaugagacccaugccccuccugguuaucccacucagagugcccuucaacagcuacagggcuggcccauccuuucucuguuaccuucggaggaagccuucucuagauaccaucuuuaaaacagcaaucuuccuucuccauccccagcagcaccucugacccccuucaccugcuuuauuuuucuccauauuaucauugccaucaauccaagcacaauuuccaguuacuuacccauuuugcuuucuccccgcucuuugagaaugcuggcuccaacagggcagguauuucaccuguuuuguuuaugccugcauccccaucacuaggaaccucauaggugcuuagcaaauuuuugaucuuaauacagaaauugacucucacagaauaagaagaaggagcuugaagccgagguuugugcccagaagaucucacuagauucuuuauacucuggggagaagaaaggaucagggucggguggggacaucugugggcauauuggggagggggccaggaagaagccaggaagggggcaugcugucauucguggguuuugcaacuuucuguggcauagaaggcauagaaggaucucuucauuuaaaaggucagguuggauuuuuuuuuuuuaacuucaacaccaguuaacuuacuugcuuccaucauacccuguagguacucguuauggacaggaauacauguagggugaaggcugcucugggucaguggauucacagagaagucagaauucucuuuuauaaagagccugcuuuucucaauaauugcauaaugacgucuuugauucccaggcccucaugccuagcuguuuccuuaggcauuuauucaagauccgagaugccauucgcaauccagcaggaugcauauuuguaucuggcuccaaaacuuuuuuuuuuuuuuuuuggcccacaucacugcagcccauggcagaagagucuagcaauuagcaggaacugaaagugauaauuuauugcaaccaacgcugugaucuaauagucacacauuacaaaagcaaaauccauauuuuguucgcaguggcaccgcagcgcuaucauaugcuccacaugcuuucuaaugucuuuuguuuguauuaggaaaaaacauaacccucuccuacugagaaccagagagagccccucagguucugagaaugacgacauucaacaucguacuccaaaggggguuagguuugugugcuaggggugaacgcugugcaauuuaauucuguuuccaaaagaucuuuggaggauaaaggauacuuucugucuuuuauuuagggaaggcgaucauguuggcacagggcauaagagaguagcggggcugagagugggaacugaggagauucaagccuuuugcccgucgaucgcaguucagaucuguugauuuugaccauugcaucuugccucacaucugaacuucaggugaaguuucaaaccaccaggcaacaugcauuacaggcaaaaugauaagucagguccugccgggugacuaaggcaguguggcaaugcuucaagccuuuaaaaccauaucccaguggccccaaagcauuaauaugucuggaacauugccuguccaauaucuagagaggcgccugcagaauuugauuccuagguacaucaaguuuuugagcuggaagaaacuugagacgcucuuuaguccagcaaauuucaaaccugucugcucaucagaaucaccugggagcuugaaaacacacagaugccugggccucaccauccagagagacauucauuugauugcagauugaauccagaagcucuaagcagaggcacagucacauuuggggacuccuuuuauuuaguagaggaggaaacugagucucagugucugagacagacaguggggauugaacacagacaccugacucccagugggugguauuuucuccuagagugcauuucugcuucuuaaccagcagaagaaagcccauuaacuaaccccucaggggucaccaugggcaaaggagugcauauuaagaacugucuggaaagaaaagaaggucauuggaaucuucuucaccccuucccugguacugaugguugcauuucaauggauuucuccaaaagcaauuaucacaguguuccuguguguugagcaaacuucccuuguaaucaccuuagcguuuucuuuuguuaaagaguaagaagaaugguuucauagugaauuuuuccuaaaaugugcaggguguagaagaaggaauugcacacaauacaugucuacuaggcaggucaacauaaaugaguagaggcagguaauaacccagauacacuuuguuggaaaguggaaugcauagaaauggucuucauuucugcaaagaaaaauguacauucuccuuuuuuuccuugcaauauguugccuucucuguauaucuuuuaaaauuucuacuucugauagaguaaaggguauaguuuuguccguuuuguguugcuauaacaaaauaccugagacuggguaauucauaaagaaaagaaguuuguuugauucacaguucucaugccuggaaaguucaagauuaagcaucuggggagggccucaggcugcuuucacuccuggcagaaggcaaagagaagccagugugugcagagaucacaugggcagagaggaagcaagagagaagggaagugccaggcucuuuuaaacaaccagcucccgugggaaaucacagagggagaacucacucacuaccaugaggauggcaugaagcccuucaugagggauccguccccaugacccaaacaccucccgguaggcuccaucuccugacaucuucacacaagagaucaaaugucaacaugagauuugguggggacaggcaaaccagauccaaaccauagugacuaugauauaucuuucacauuucucuuuacaaaaagaaaaacaauguaaggucccgugacaauuagccuuacugccggggagaccauaaggagugguggagacugugguaaacugcagcgcgcacacucuguuaacagaggaggucacuuuccauucuagcugacuguugucauaugaggauacacaacuaugcuggccaguuucuuuaauuuuuuuucucuucuaacagaaucuagaaauguagauugugugugcguguguguguguguguuugugagagagagagagagagagagagagaaaucuuuaggaguuuuaaauauuggcaacuaauucaauuuauuucuguuuuuaacauauugcaccaaauacauggguaugggccgaaaauaacaugaacuuuuugcaguguacaaaucucuaauuugagacuucuaaugaaaagauauuugguuacaguaugagagacaagggacuaaaauaagguuguggaucauucaggguuaaaucagagcaacagcaugaguaggagauauauagaaacagauuuauugcaaggaguuggcuuaugcaauaguaggguugccuaggcaagucugaaauccauacagugggcagucgagagaggcagacaggaacucuuggcauaugcuaaagcugcuauccacaggcagaauuucuucuucuccaggaaaagaaacaguucuucucuuaaaaucuuccaaaugauugacuccgucacacucagaccaucuaagauuaucucccuuccuaaaaggcagcugaauaagggcuucaaucacaucuacaaaauacugucccagcaacaccuugauucauguuugacuggauaacuggaaacuauagccuagccaggguggcaaacaaaauggaccaucccaggguagauguuaaaaaaaagauacccaccaaagauaaauaagaucaagauuagaaugucuucuuuugauaggaugucugauuuuucugaauuuuuguuccuaaaacauaagauuauuuuuaaaagccugagaaacgagacauuagugauccgauucagaaaagaagcccuggguuuaagccaauacgagauggguuuguaucuuuaaguggccuuuauuaccacaguaauaaacagcaaacgggcccaaaucuuacaggcuuguguuggcuuugaccaaugaaguagaacaagaccucugaauaccccguuaguuccaggcugugcuuugauggcucugcacagacagcucuuuuccuauacaagucaccagccucacccgugucucuuaacaaauguuguugacaggccgcguugcaauuuuucugcauguucugacaguuuaauucaguaccuccuagcuaagcacucagccuaagggggugcuucagcaccuuggcgucaccaggcugcaauuaaaauaauucagggacuggggcugggcuugcagaaauaggccuucuucccuuuggaacauacaaugcauuuuccagucuccccguggagcacacgagauccuuuuagagcagagggcaguggaauguauuaacaagauguccacuggcaagaacuagcuccauuuguauguugcacccaacgggguuuucuccauagggguuaggcguaacgucuuugguaaacuuggcaccuguagaaaggucuuguggugggcaggggggugugaaugggggaaugagaacuagggaacccaggacccaggacccaggacgagaguucagcaaagaccauuuacagaagcuauccuuccaaaacggccacucagaaauggugucuuuuauuuugcauucuguacaggaaggacaaauggagaaaagucuccagaaauuggccucguuugaaaggaccucaugcaaagagagaucuuuggagacauuucagaaagguuuuuauucaaacauauucgcagcuuguaugacaguggaauguuuugaaaugagcuugauucuguuuacccauccuucuuaauccaacaacucugcuggucucucugcugacacaagaucguucgcagguuauagaaggauuuaacacgucagguaagguggaauuugguaaauuccccaaauuuacaaauagaugaaaguuggguaaauuccccaaaauuacuugaugacaaagaucauuugggagagauucuuucaaaaaugccuacucccuauucccauaucccagccuaagggaaugaguuuaagugggucuacaguggguccugggaauuugcuucuuaucuagcaucccuggugaaucuuuucauucaagccaaugcaggaaguaguccucugaaauacauguccacagaacacgccgugcuuuccagaagacgcaacagacagaaacuuuccaaagggaauuaccugggaucauuucucauccucucucucuuucucuguauuacuuagccuuaaaaaaaaaaaaaaaaggacuaauacuuccugcuuucacaucuacuuuccagauaguuuuuucuagagguaggagguacauaagagaaacguguuuuauggcugugguuuucaagaaguacagcguuuuggagagaguggaaggcuuucaugcaugaaacacucagggagguaggagauccaugagauccaagcuaaacaauucuggaagaguuaccugaaguugacacuuaauucaagcugcaucaucuuccuccucccagcagaugaagaccaaagguggagggugguggggguggggggcagggaguaggggggagggggggaggggguguggggaggguggggcgggggugggcagguucagggacugaggccggaagcaaaacaauguacuggagugcuuauaguuuuugaggaaucagugagaaaugucaucugaaugucucuucucaaucuuucugaaagauaacuugccuauaaacauaaaauuaaaagcuugcugucugcuuaguucagguauugggucagcgucuugugacuauggacaagagguguuugacucuaggacucagcuaccucaucuguuaaaugggcaaacugggaggguguuuaucugcaugcaacaucuccuuccauuugaaaacuuuuaugaauguauggaauauuauugagcuggugugugcuaauacacugcuaggagccauuggagauuugaaaugugagagaaugccugcugucugucgcauuuaccaaacaucaugcuuuucaagauuguuaaaaguugcugaaacccuucuuugaaggaaaucauacuuugaagcucaauauauagcaaacggguagaagaguugcuaagaguuugaaaaugaucucauuaaacaagaaacauauauacagugccuaccuaggaaagagccaggcauauaauagccacugcauaaagaugucaagucuuuuggacacaauccuaauaucucggagguucugaagcuaaaggguacauguuuaaauuuuauuuguuucauuaaacaccuaaagacucuuucuagcucacuccugccaaaggcagaacuugagaguggcauucuuuucuggucuuugaagacgacaggugaagggcagaauguccuguguacuugggcacgcacaugcaacccuggcugguggcuccuccucucuguccucuuccucccucucuuccuucucuuccuuuucuuccucauccuccuuuuccuccuccucuucuccuuucuccucauccucuucuucccucuucuuuguguccuuguuuccauuugcuucuugcuuugggcaaguucucaccauaacccucuggcaaaggcaaauauucaccuaagugguuaagucucugggcauauuuguugaucucugcugagucucucagcccguuuucaucccuccucugccucucccuagccauuagccaaggccuugaccuauugacugcaguguugccgaagcagcuggacuccguguuugaaagguuuucugaagaggcaucuauuaauuuauguauuuaauuucuguaugaagugacuguucuccucccagcacagguauuaaaguaccuuuaggggaauccagcagcugaaauccucaguaaggaaaaaugcuuagagugucacaaagcaaacgcauuagugggaaauguuuaggggcucaagcacaaccacaaggauucacuccuuccuuggauuuugugccucuuccccuguuccugaggcccccacugggaacccuuagcuggagaacacccguuucauuauggaacauggagaaaagggugauugucagcuccaauuuauuccauacuaucugauucaaucuguaguuugacuuugcuaaaggaauuaauuuuuaagaucuuaacaaauccaguaacauuuaaaaugaccuauccaguccaugcauauuagcuauucauaaaggguuuuaaacauuauuauuaauccuagauauguuacuuaaacuauuaaguccguucaaggcauucaguuucugaguccucaaggaugguaaggagagcugcaaaugggcucccuucucaagcaaaggcaucuuaugccaucaugcacguuucuacacaucugccuguagauacacucuguaggacaaaccagguggcucuguccuucaggcaaagagcuccuuaauugaaaaugaugugugaaauuucaagagagaagucuaggaauggggagauuuauguacuauagucaguaaccaauccugagcaaagguaggcacagcuaugugguggugcccuuuuuugggggggggggggcgggugguggggguacuuacuaaggaccuugccuaagauaaucaacaauuuuucuuuuucagcccugggaggcucuaaagcuggaaucaaaaagauucacaaccccacaaauaggugaacuacucuaaagcaaugguuuucaaaccuugaaauauccuaacauugaaaaaaaaugugguaacauaggguugccugugucuuauuuuggucuguaaggacauuaauaauguuuugguaaaaccucaguuaucaucugcuauuacuguuauuucauaagacacaucauuuuccuucaaaauuacaaugaaaacucauaagcauacaucaaaguugaaagaauuuuacagcgaaccaccauuaacauuuugcuauaauggcuuuaucauauauccauucauccgucuaucauauuuguaaaacaaauaauauuuuaaugccaaacauauacaaaggauagaucaguaauuuccgagaaauauuaguugacaacuugacaucaaauuauguacgguuaaguauugauacaaaaauacgcacgaauauuaaguguugaggcagauagaugcacauauguaugucaccauguaccuuugugucuccuugcauuuaaaaaugcaggucaugauguguaauccccguuccucuguugaucagugaacacaaaugcugggccccagcaugaguccuuuucagagagucauuuggagaccuacagaaaaaaaugccaagaaugcacgcugggaauucauuaagagauuucaggacguugaaauacugugcguacuugcaauccccacuugaccaaagguguccaaaccucgacagacagcggccagagaaggccccaucauagacucugcgccuggcuaauuacucaggagcaaagcaggucguuaggggucagggggagggugcaccuguccgccaccccaauuuccucaugauacuggaaggcagucuccggucagcacggggcugggucuagaguuuucaguuuacaaaaguggaaaaugugauaugacagacuggaaccagcacagggacgcagccccucaccugcugggggucuuuggguggguccuguagccccagagccucucgaugagcuaugaacaggaacagaaccagcaccccgaguggugacagugacaaaaggguccucaguaacagcagucugcuauuguuuugaaucauucaaaggaauuuuuuuauuuugauagugaaaacaauuucuuuuagauguagaaaggguagaaaauacagauaagcgaaaauaacaaaagcagaacggucaucaucucaaaacucagagaaaagggcaccaacuccauauucguacccauguacguauucauacccauaucuauacaccuucccuuaucccugucccugucuacacccacacccauaccuaaaccaauauccacauuuauaucuauaccuauacccauaucaauaucuauauuuaaaucuguguauuuagauauuucuagaaaugcauauauagcuauuuuugcuuuuauaaaaaaagucacagaaacaauuauauuguacacaguccuauauaaucugcuuucuuuuguuuauagaauacugugaaugucuuuuuguuuuuuuuuuuuuuguuugcgagacagggucucacucugucacucaggcuggagugcaguagugcaaucuuggcucacugcaaccuccaucuccuggaugccagcaauccucccaccucauccucccaaauaccugagacuacaggcagucaccaccacacccagcuaaauuucuuuuguguugcuauuuuuauuagaaacgggguuucaccuuuuuacacaagcuggccuugaacuccuggacucaagcgaucugcccuucuuggccucccgaaguguuggaauuauaggcaugagccacugcacugggccaggaauaucuuucuaugacaguaaauauuauuuuacaucauuuucagugauaccauaguaucccauuauaugcuuuucaguaauaaguucgaagccaaguuccuggaucagcagcaucagaaucaccugggaauuuguuagaaauggaaauucuuaggccacuccccagaccuacugcgucugggggcagggcccagccgucuauauuucagcaagccuuccaagagacuucagugccugcuaaaguuugaugccuacugccuuaaauaaacuucuucaucccuugucaaacuuccuaggggagcacauuuugaauuuuugaccugagaccucaaaacuuuuaccugugcucacucaguucaggugaaagaaucuuuggcauucagaagcuuguguucacacucaccuacuucucauggcaugauuccucuuaccucuaaauucuacugacuuaaucaagauugagggauucugggaugaaucuggggacacuuuuuggucccugaaauaaaauacgcaaacuuuggaguaugagugcguauuuggggaaaguauaccuaucagauuuucaagaacuucaugacccuaaaaugacucuuucuuaaaauaauuuuuuuuuuuuuuuuuuuuuuuuuuuuuuuuuggagaacggucugguucugucacccagguuggaaugcagugucaggaucauagcuccacugugugaccucaaacucuugggcucaagcaacucuccugccucaagcaacucuccagccucagccuccgaguaacugagacuacagguugugugccaccauacccagauaauuuuuuuuuaacuuuuuuucuuuuuuuuuuuuuuuuuuuugagauggagucuuguucuuaugccgaggcuggagugaaguggcaccaucucugcucacuacaacaucugccccccggguucaagcgauucuccugccucagccucucgaguagcugggauucugggugccccccgcaaccaugucccacgaauuuuuguauuguuaguagaguugggguuucaccaugguggccaggcuggucucgaucuccugaccucaggugaugcacccaccuuggucucccaaagugcugggauuacaggcaugggccaccgcucccagccuuuaacuuuuuguagaggcagaaucuuacuauguugcccagguuggucuucaacuccugagcucaagugauccgcccuucuccgccucccaaagugcugggaugacaggcacgaaucaccgcgcccagcccaaaaugacuuuuuauuuguuauuuuugaucucauccuugcuguucuguuuugcccagguuggucuucaacuccugagcucaagugauccgcccuucucggccucccaaagugcugggaugacaggcacgagucaccgcgcccagcccaaaaugacuuuuuauuuguuauuuuuguucucauccuugcuguucuguuuuucccaguuauaucaauaacaaagaaaagaaaagaaaucuacucagggucuguugggcauacugcccaagcacagugugaaaugacugccuuuucacuuuuuaucuuuuggauagcccaaagaccagccugacuuagcagccugauuuuucuuugcuggaggcagaucacacucugcagaucuccacugaaaccccacccucacccuucguaauaggcgacaugcacauuuucaugucacauuuaaaaaugaaauuuuucuugaaaauguucacauccuucccccagaaauucuagauuuauaaauuucucccaaggaaaucauuaggugcuacaugaaaguuuauguaucagguaaugaucacaaaauuauaaucacaaauuaaaauagccauaaugucuaauaauucgacauuagugacagagaugauacuacaguuauaggaugaagugucauaacuggggauuuuggaaaaugauuagggacauggugaagucgucauagaauaaaauuaagugaaaagagucagguugaguguagaauauauuuauuccuauucagcauauguauuacaaaauaucugggauaaaugagaacugcaugcugacauuuacauuuucuccuugauugucuuaucuauuaucaggauuuucuacaaugaacauuuguugguuuauaauuggggggaaaccuaaauucauaaaauaggcacucuguugguggcaaggaagcccacuaguccacugucuaaguguuaaauggauuuuagcuucauaauucuggcuuugacuagacccucuuacaagcaagacuauauccucugcaaaagcaucagcgggguccugcagugccuucuugacacacacaucaguguauacccagagcucuuguuucuaaauagcugagcugcguauuaaguauggcuaaccacacauccaugcauuuuucuggugucuaccugaccaccccuccaggggagagauaaacucaaaggggagaaaaagguaugggagcgaaagauugcaaggugcagguauguuugcagaugaagggauuguccaggcugagcugugcaguccuggaugaaccaccaucugggcacuucauaugccauucauacuuaagggugauuggcuauuuucaucaucaagaaaaacauugcuuuaaaauuuuccauaguuauucgggcaugguggcucaagccuguaauccuagcacuuugagaggcugaggcaggaggauugcuugagcccaggaguuugagaccagcccgggcaacacagugagaccccaccucuacaaaaaauaaaaaauuaguuagguguaguggcgugugccuguaauccuagcuacuugggaggcuguggccugaggacugcuugaguccuggaggucgagacugcagugagccaugaucaugccgcugcacuccagcauacgugacagagcaagaccuugucucaaaaaauuuaaaaaaaaaaguuuuuuuuuuuuaaucgccauaaucuugugugaaauacuuggucaucugagcaacauuauccuucuucuccccaucagccuggcaugagcuuggcagaugcaagcucagaucaucaccugugugaguguguugucuuuguguccgugagcaugugugugugcccuggguuccucucccagguacuccagagcucuugacaauaaaugagaacaauauagaggcagggggcacuuuucaucucaggccaguuccaggacucuguguaaacuguacuaagccgaaacguauuccuuugucccuuuugccgcuguccuccuaauccacaucugggcagugugcacuguggcugggaguugacacagauccuugucucccagacccccaguuucuaucgagcuacuguaacuuuaaaaagauuuaacaaagacuaccuccacuagcuaagcugaaauaagaaugucuccggaguuuaauggaucaaguagcggugauagguuuuauggcucuuuuuuacuuuagggcauagggaagagagagccgggcagguugguuuuaaauucaaggauuuauguuguuaauccuccgggcuaauuauaauuuaugggaucuuggcaaauuaauaugcaguugcuauucaaaaguggagagcaauguaaggcaggcauaaacaagccuuguucauuuuuaauuuauuuccaccaauggagaauauuaaauaaaaugaacacugggguauuucgcuccaaguuugguguucauuauuuaucucuaaauuaugauauucauagaacaacuccuugcuuuuucaccaagaaucuagaaucuagaauuaucugagcguucgcaucagauaacuaggaagaaaucagagucauuuucucucuaaggcaggcucgaugauaccugcacagaagcagagguuucccaagcaugcauguuacugcaguacaagauuuggcauucugcauguugggguuguuuagaaacagaaacuuuggaguaguaugugagcuuaaaaugucaguugcauggaaaugaaagugccaacccuccaaaucaagaguccagcccguuaugucgcaagggcuuugggaaaucucaauuuauugcuagccugguagauauugagcagggugugauccuguuauugggcuuucagacuuucgcuuagcaaccucauugcacccaggacccccauuuaaucagcgacuccuauggcuguuugggggcucucuuucaaauaauucuucucacccaugaacaucugucagaaaacuuucacugauuggcaaccaccaggcagguagguuugacucaugugauaauugguugcaccacuagaaaugagaaugccccuccuacuuccccgccaccucuucuccucuuaccuuuuucuccccgacaugccccugccaaccuccccccaucauuccagcugggagaggccaucaaauguagcuuggagagcuauagaaaccuugagcucugagcccaaggagcaaguuggaguccugccuccagcuguguagcucagauaacagcuggagcagagaacaugcuguucucucugcuagaauaucugacccaauucugacuaguaaagagaguuaauaguuuguaccucaagucauucuugucccugugugaaggaagagaagcagucauuucccuccaccuccaacacacacuccguccccacucugucucucuuggcuguuuuucucuucauuguuguuaaacucacguucauuucucuuguagucagggaaaugaagagccacuuucaacaauucugaagaagaaauaugggauguuuugcuucgggauggaggcuggagcaggaguuucuggagucugccaguacccaguuugaaucccagcucugccuuuuaucagcuggguguugggcaaguuagcugacuuuugugaguuuucucaucauuaaaaugagaacacuguuauuggucuuucgggauuguuuugagaaaugagauaucgagacaugccuggcacaaggccuuaauucuucuucauggucaagaaauggcagauuuucccccuuccauucccacccuugcacauaguagguucucagcaaguauuuguagauguaaucgaccagcagagaucauuuguacccuuaacacccacagagagucacagaugcuuucacugaaggagggugucccaagacucaauggcagggaauaaaaaugccaagucauguaaguauuccacaaaguuagaggggaggaguaaguaucucuuauucgugcaucuuuaugguaugaccaagggcucaugauuuguaagcaguucaggcacugagacccgggacacaggugacacuguaucugcagauuccuuuuucucauuguuucucugucauguuuaauuuuugguuuugaaaacagcagaaaauccaaccaguguguucacaggacuucuggcuuugcagcaauuccuuuuucuggggucuuuugccuaaucguuuacugguuuggagacacuguuuucuguauuguuuaggacugaaaauguagaccuaacugaaaucaagcacucgaguauccuaauuauuuuaaauucauaaugaauagucaucaugguuucacuuuuuuuauguacucuuuugaaagaguacgaugggggaauaaaagccagaaaguuaaaaaauaaaaauagaaaagagcugcaauugucaagagaccaaaaagucuuguaaaaagggcaguagguaauucuggaggcaaaucagcauggguaaugucuaggcaaacaggauagaaaaagaucaggaggucacagugacaaaaguauuuaggcucaucauauuagaauuucauccaaagaacaauugauuaugauuuauagaccacaccaucccaugagcccagauguguguccacugggccuggcaggggacaaauuuauguaacagacuccauccugaauuccaguccucaagcuuugaggguaauaaacucaagcuuugcaacugggucaagaucaggccugucuccuucuugaugaugaguugucucauaggacccuguuaagcaccauccccaaacuccauucuuuuuggugaauaucccaacaaacuccccagccauaccucaauguccagacuugccugauccccagggcuggacacagaacaggcucauucugagaaucuucucucucucccuccuucccauuuugcuccuccuaccaacaugagaagcuagggggucucaucuuuaaauaauuaauucuucuuucuuuguaaguauuauacaugccaaacagacucuugguuugugucuacugacccaacaaaagggcuguccacuugacggacaggcaacagaucaucuugauaaguacaugaggcacucagaugucaagucaccaaaccuucauucugaauauuuuugaggcucaugacagaccaaaagagccagagaguuggggaacauaauuuccuuugcucauacccuggaccaagaacuguugccaggaauauccauccaucugggggcuuccagcuuccccagaugccugcgugccuuuugacccuucuccuucccccacccugcgaguucuucaacaaauacucuucuaaaccaacauccccggcaaacgggagcaagacaccagcuuuucacugaugcagauauuucugaucuuuucaucucgguuuuauuucucacucucccacugcauaaaagauuaagaaagcacucgcaugaauguuugcacaucauuuaaauauucauuuucauuaauuuauucauagucguaaaguuuauugccuagaauauagagucguagaauuuuagagcuggaagacaggagagaaaucaucuaguuucgccgccucguuuuacagaugaggaaacugaggugaagacagcucaggagaccguccaaggucagauucugaagugagccaagugagacccaaacucaagucuuggacagucuagccucugugcagcgcagcucagcacagcugaaaaccacuuuugcucucugcuggcauagauggcugugcuuugguucauuuucuugcucaucuucaugaucuagcaaguucuuguugagugccagcccagugccaggugcugaagaacaauggugaacggcacagucaugguaccagaacucggucugguggaacagagagauuaagcaaucagaaaaacauauguguguguaauuacacguugugauaaggguuuuguggggaauauacaagcucaauguggagacuaguggugggagggcagaggcauuuucccaggaaguggagaaagggaaggggaagcaaaagccaucccagggugcguuagggagcagguacugcuguggaugacgggugaagaauucaccugggaaacuuggggagaccauguggaacaugccgucucugaguuaugccccaucagggggcaaagaaacuggaguacuuacccaccagauccucaucugucguugguugaggacugcucucaggacauucacauccaggcacuucugguccacaccuugguacaacauuugcaauauuagggacaugcuaauacaauuauucauuguauauguuaauucaaauuaaauggaauguccuauauuuuauagggcaaacuuaggcuuacgccuggguggaaugagcaaucccugucgccaaagaagguccccagcauagcaguuggcuggagaaggaagggcugaccauaaguugcacuaaacugcucucagcagggugaccuggaagaucuuggaguguagaugucaauuaaggcaaguccugagggcucggauggagccaacuuuucacccgaggaggggaagagggaggguuaaggagggcaaaggagagauuuccaggcaaagugcacauuaaacaccagaugcgaagagcuagacccccuuaaugacaauuugcuuucuguaaucuugaaccagggucucucaguguguggaaggaauguuugaaucggaguagcagggcugaguggcaguccuaaggcccagccacaacguguucuugacaagccaugucuaugucuggcgaugugcucgcauggcacaugauccuguuugacuuccugacagccccaggugcuggccuaaggccuuccaaaugaggaaggaaggcuggaagaaguuaagucauuugcuaguaaggguuagagccaggauuugaacccagaugacuacagaguucaugcuuuuaauugcugcuuguuaagugcaucuauuauggguugaauugcauccccccagaagauauguugaagucccauccuguuaccugugaauguaaccucauuuggaaguagggucuuugcagaugucaucaaauuaaugugagaucuggcuggauuaagauggagccucaauccagugacuggugucuuuauuagagaaaagagagggagauuuggagagacacacgugugugcacacauaucuacguaucuacauguaugcacauaccuacaugcaugcacauaccuacaugcacacacgugugcacacacacaagcagaaggccaugugaagauggaggcagauacuggagcgaugcugccauaagccagggaacagcaagcauugccauccaccaccaggagcuggaaguggcaaggauauguucugcccuagagccuucggagggagcgcagcgccagagacaccuugaauucagacucuuugaguuccugaauaaagagagaauaaacuuguauuguuucaagccaccuaguuuguggcacuuuguuauggcagccccaggaaaggaacacagcauccccugucaacaaaccaaggggagcuaaagauauacccuuuagccaaguaaaccagcugccccgagcaggagcacagcuuccagaucacucaucaaggggccgugggugacagggcuggccugcugcugccuuuaaugggcguagauguuguuguucauguuucccagcccauuggugaugacacagaggcaggagccggggcugcagacuaaauuauauacaucucaagggcaguuagacaauuagcucgcccacaggaacauugcaauaagcacaguaucugcuuucccagcaaagccaagugcaaguuccugccugcucugaugaccucuugugccuccagugugggaagggaccaggucccucaaugcugccgccucccacccugugcugccacguggauuuaacuccuucguguuccccauguucuuagucaguaugguuguugugccauggauucaaaugggguugcuugauuugauuugcccuuuacuuggcuggaauucucucuaacaaucaauggaaacacagcucauagggaugcauguagccugucucauaugugaaaaagaaacuuucaauguauacuucaucucauuccaacaagaauuggaaacagcaacaucaggacuuauauggugcaggguggucaguaaguaggaaagaaacucggggcauggaagugaacaggaagcccagagugaagccaggacccaaaacccacaggugcugcucuuguuauaagccagccacacauuugucuuugagccuuuuagcagcugccacaaacugggagaaaccaucaguuaugcaguuuacaauaucucuaaacucaaaacaagccaguaauucagaaaaagcccaguucuucucacaaagaaagaucuaagugugauaugagaguauaugcauggagaauauuuucugagcuggugaugagcugcagggggccucucccagcccccgcacugguugcacuuuuaaauaagagaaaaaaacagugauaggacugaccugcguguagaaguuucaaguuacaagaaaaacacuucacaggauccaaauccuuaaaguccugaaggaaacagagagcauauacaccagcuuucgccacccaauucggauguguuagaaugaagagucucuuauuuuuuaaugaauuuuucucuauuuaaaaguacagggauaccucagagauauugcagaucccguuccagaccaccacaauaaagcaaauaucucaauaaggcaagucacaugaauuuuggaguuucccagugcauacaaaaguugcuuacacgauauaauagacucuuaaguguacaauagcauuguaagaaaacaauguacauaccuuaauuuuaaaauauuucauuacuaaaaaaugcuaaugaucaucugagccuucagcaaguugucaucuuuuugcugguggagggucuugccuugauguugauggcugcugauggaucaaguuggcgguugcugaagguugggguggcuguggcaauuucuuaaaauaagacaaggauaaagcuugcugcauggauugacucuuccuuuuacaaaaggauucucuguagcaugcacugccguuugacaucauuuuacucacagcagaauuuaucucaaaaguggaaucaguucucucaaacucgccacugcuuuaucaguuaaguuuauggaauauucuaaauccucuguugucauuucaacaacauucaugacguuguucaugacaauguucaguguucgccuucaggaagagcaaguuccauugcaagaaaucacuuucuuugcucaucucuaagaagcaagugcucauccauucaaguuuucucaugagauugcagcaauuuagucacaucaucaggcucuacuucuaacucgaguucucuugcuauuucuaccacauaugagucuugaaggggcucaagacuuacuuccuccacuaacuuuugaaccccucagagucacccaagaagguggaauaaacuucuuccaaacucuuguuauuauuaauuuuugauccuuugccaugaaucacgaauguucuuaauggcaucuagaaugcugaauccuuucuagaagauuuucaauuuacuuagcccagauccaucagaagaauacaguaucuguggcaccuguaggcuucuaaaauguauuucuuuaauaauaauacuugauaguugaaauuacucuuugauacauaggcugcagacugggcauuguauuagcaggcauggaaacuacauuaaucuuguacaucuccaucagagcucuuagguacgagguacauugucaacaaguggaauauuuuuauuuuuuuuauuguuauuguuuugagacagccuggucuggaaugcacuggcaugacugcagcucaaauuauccuccuacuccagccuucccaguagcugggacuacaggcacaugccacuaggcugggcuauuuuuguauuuuuaguagagacacaauuucaccguguugcccaggcuggucuugaacuuguggugaaucaaucugcccaaaucagccucccacagugccacaauuacaggugugagccaccacacuggaccaagcagaauauuuuuaaaggaauacaaauuuuuucccaacaguaggucucgacagugggcauaaauuauucaguaaaucaugccauaaauagacguggucucauccaggguuuguuauuccauuuauagagcacagggagaguagguuuagcauaauucuuaaggacccuaggauuuugggaaugguaaaugagcuuggcuucaacuugaagucaccagcagggaagagagucagccugugcuucgcagcuuugaagccaggcauugccuucuccucccuagcucucaaaguccuagacagcaucuucuuccaacagaaagcuguuuugucuacauugaaaaucuguuaguguagccaccuuaguggucuuaucuagaucuucuggaaaacuugcugcagcuucugcaucagcacuugcugcuucauguugcacuuuuuuguuauggagacggcuuucuuccuuaaaccucaugaaccgaccucugcuagcuuccaaguuuucuucugcagcuuccucaccccucucagccuucacacaauuauagagagugagggccuugcucuggauuagauuuuggcuucagggaauguuguggcugguuugauccuguauccaaaccacucaaacauucuucauaugggugauaacgcuguuuugguuucuaucauuuguguguucacuagaauagcacuuuuaauuuccuucaagaacuuuuucuuugcauucacaacuugccuguuuggcacgagaucuggcuuucagccuaugucaguuuucgacauggcuuucucguuaagcuuaaucacuucuagcuuuugauuuaaagugagagacaugcaacucugacuuucucuugggcacugaaaagccauugaaggguuguaaguuugccuaauuucaauacuguugugucucagguaauagggaggcccaaggagggggaaagagaaggagaacagcagguugcuggagccagugugguauucauaaauauaacauuuaucaauuaaguuugccaucugauaugggugcaguuuguggugccccaaaaaaugacaauggggacaucaaagaucacugaucacagaucaccaaaacugauauaauaauaauuuaaaagcuugaaauauuguaagaauuaucaaaaugugauacagagacaugaagugagcagguaccauuggaaaaauggugccgauagucuuccuuaaugcaaaguugccagaaaccuucgauuuguaaaaaacacaguauuugcaaagugcaauaaaaggaaaugcaauaaaaugagguaugccgauaauacauacagcucagugaagaauaucuuaaaaauauuuaaaaagaaggaagaaaaucacucauaauucugcugcccauggcaaccacaauuaacccaugccugccuuccagucuuuuuaccacguguuguguugugugguguuugucccacauagagaucauugccauacgcccauuuggcacauugcuuauuuuucccugucuuuauacauuucaucauguuguucuaaaugcuucuuaacugcaauucuuagugguugugauaguccacagaggggaagcauugcuguuuauuuauccauuucuauguuguuggucauuuauaugguuuuaaauacuuuuggugucauaaggaguguugugauaaacaucucugugcauaaagcaguuucuauaguucccauuaugucuuuaggauagauucccagaaauggaauuacuaggucaaagguugggcacauuuuuuaaagguuugugagacauauugccaaauugcucuccaaaagguuuguagcaauuuaaaugaucagaagcagcacugaaguccaguuucgucuaaccaguauugagugcucauuaaaaaaaaaaaaaucauuacuaauaugauaaacaaacaaaugguguguuauuguuggguugaaagaagcaaauuuggagaauccagagaaacacagcggaaauucaauuuaugggcuacauuaacccagcauuuuggauuggaggguuucuaaagagguuucguuauauuaauggaugacaaguggauacuuaagaaaaaguguauuuuggagaaaguugcaauaauaccuacuagagauuguguccucccucaaaaucggagugccauccgcgcuccaugagucugacacuuuguaggugcuuuauaaauauggauugaagcaaaugagugacguucauaugauguuuugcaguuuuuucaaaguggguuuuacauugagaaucucauuuuuccaacaaggcaacuaaggcauggauucaauaaugugccagcggcacacacauagcaaaugguccagccacgaagagaacgggacuguccagccgggaggacaguaugcuuuucaccucccucuguacccuucucugagaacuguuugguuugaaucaugauggcaguggcuggcuucuccacgaugcuguugugcugaacccuauuaaccucauagggaagacacuaggaucaagaggccagagaagagacccagagccagcaaacaagacauaggguuuuauuagggguuuaccuacaaaggagagaguuuaguggcagugggcugggcaggagaacugccuuauguacagaaaugguucaggggccguggaauggacaagacuccacuuuccuacaguccagugucaguggcuggacaacauaaccacacagcccaguggccguggccugggcagggaaaccgcaacugccugcaggaagagugcaguuuauuuagauaacauuuucacuuaacauccugccguuaaugaccuccaccuggcaaccuuuauuuaauccaaaacucagggacuggauuuuccauacggccugugaggccagggggcucaguuguuccucauagacagggaauguaucuccugauuggccacucccagauucccuagcuaggaacagacauucagguacauauacccuucagagagucauucucaagguaugcucaagcuauugcugucaggcgcauuuacccuacagagcugaacuaccauuuccucaaaaguagguacagaugggguaacagugggcaauguggcccuuucugcacuuccacaguacccgaaguuuaggcgccccuccugccaagagcccccauuagcagcaaaauauaucucacauggugcccagagcaaaggacccugugcuaguuuuuuguggcugcuguaauaacggcaaacugagugacguaaaacagcagagauacauuugcucacgguguuggagcccagacgucugaaauugacacugcuucuggggacacuagaggagacuuuguucuucgcccuucccggcuucaggucgcgguaagcauuccuuaacugguggucacauuacucuaucugugccuccauggucacuuggacuucccuucugucugucugaaauuucccucugcguuuauuuuuuguuguuguuuguuucugagacacagucucacucuguugccccggcuggagugcaguggcaugaucuuggcucacugcauccuccaucucccaggcuuaaguaauucuccugccgcagccuccugaguagaugggauuacaggcgugcgccaccaugcccggucaauuuuuguauuuuuaguagagacgagguuucaccauguuggccaggcugguuucgaacucgugaccucaggugauccaccugccuuggccucccaaagugcugggauuacaggcgugagucaccaugccuggcuaucugcguuucuucuguaaggauacuugucuuuaaauguaggacccacuuggaauauccagaacuaucguaucaaaaaauguuuacucacaccugcguauacccuguuuccaaauagagucacaguuacagguuccggggaguugacauggguauccucuggggcagggggcacuuuucugccuaccacagauacugaggugcauugcuaauuacaugaguacagcauuugugaaaacucgcucaugauaucuucuccauagucgcagucaguaccagcugcuguggaaaaaauuuuacgcauuguguuuacaacagaauauauaacauggcuuagagacaaaguguuuuacuuauggccaguagauggaauucuaagguccgaugucgguuugccaugacuugggcauugguuucuguucggcucuguuuacggggcugugggauggguacauagacacucgucuacuugaacuuccagggacucgggaggccugcaguugaauaacaagagaccgugcuggugagagguggaguuugcaguaggauuucaaagacuccauggaguccaaaaggugggagguguguuuuggggcaugcgccaagggaagcugggcuuugggaagagaaaagaauccgaacugguggcuucccacaauugcugggagucugagauagauucaauugggaaaacuagguuagugccagauaagguccauuacucuuuaaaaguggccacucaucccuaauaauaaauaaaccaaacauugggauauuaaaacaauucguucucagcaucagaaaagaggucguguguguguuuguguuuuuuuaauaucccauccagcccccagccccaguaacccuaagauugaacaaaacccuacuuacgugcuacggauuuaauauagcgucaggcuccucuagguacaauaaaauaccaaguuaagagcauuaauuccuuacaacccugaugggucccagcugugcacacgcauguagggugugagggugugugcucagcgggcacaggugcugacggggcuguuccaccucggagcgcgugggccgggaacacagcuguuucucaaaucauccgccacuugcuucuaaaccucugugaaguuguaccgccucugggcacaauuaaaagcuguauacuacauuucaucagguaguguuagaaauuuaggcugagccaaaaaagaaaagggaggaggugggagggaggaagcaacgagucccuuguucaggcggcauuaacccccuuacccuggcuauuggaacaauagcgcuucuaaaagccgcacaaaauccuccaauauuaagaacggagaaaaggaguguggaaaaggugugggcaagcacggcaucucuucuuucuuuuucuucuuuuucuguuucuuuccuucucuugcuauuuccuuucuuucuuuuuccuucccuuccuuccuuccuucucucuauccuuccuuuuugucccuuccuuccccucauucuuucuuucccucucucuuucuccgucuuucuuuccucccucccauacucucuacuuuucuucuucccuucccuuuguuuucacgcuaauuccuuaauuuguuuuugggucugcucgcaggaaauaaccguaagcuaggauaacugagguaaaauuuguacagcuaagcugaauggugaaaggcccagauuuaguucucauuguaggaaaaagggccagaauaccuugcccauuuuugccuugggaagugagcucaaugaaauacaucuucauaugcccauuuuacagaagcagcaacugagggcuguuguacugaggcuugcaauggccaccucaacuuuuaggucucugaggcagcaaugggacccuugccggggccucgccauccacauggucauugccucaaaauuugggauuccaguugcccuuuuccuucuucucucuugaacaaugugaacgcaaggugaggaugggccuucuccgccuucaaaaguugcugccuuccaaggggaaaaggucuggucuuguaauuucuggucugugcgugcuguauaaggaagaagguuuggguagggaagcaacagaguacccacuagugagagggaggacaccgcuggucugugcucaacagccaggccagcaccacaugaauaaagcaugauggcaauugccugacucuguccucgguggggacaggagagcugagcauaaggaucuaaguuuagacgcccuccuaggauuaccaacguaggcgugaucaggcccauaaaauacugcacaucuuggcaucuuaccuauaaaaauaaugcagauacauucguaacuccccagguuuucgggaguggaaaugagggcagcuggggagugaaucugucguuuguugagacucuuuuuccugcuugccagacacugaucuaggcucauucauacaccaguucauucauccucauaacaguucugugccugaguagauucuuguccuuauguaaggauuaaggacguugagacccagaagggucucaucuaacaggcaguaguagagccagcagucaaaauaguuugaccccaaggcuccaggcuuuuucccuauuucuuucucacccacagccaauugcaaucuggacccuuuaccugucagcuguaggaacaugaaauaaugugaguggggugaaauaaugccauuuaaaagcaggcacauuauaaagaauuaugucaaccugauuucuugaaucccaggacaauucauauccccgugccauccgauuagugaaucaagagaaacugauugauauacagcaacaauaguuaagaaacaggcagcaucgauggagguuugauuaaaccgauacccugggucuccugcuguaucaaaucaugggcgaauugguaccauuaggauaaauuacuacaagaggcacugcaaagccaagcuaaauaaacucugccuucucgagccccugauugucuuauuaaauaauuucuuugccucuuaaguguggacucggagcacucgugcucugaaagcccuccugauuaacuauagccuuggccucaaguugauuuuauaaacuucggauggugccccagagggugaagcuuccuguugucaauucugcccguugcuauagauaccaaacuccacaaucaguaauuagagcgugcccccugccccagaacuggucaaacggugcagagcgcucggcaaauggucuuaaaagcauccgcgcuugcauggaaaugcauuuccaauggugacgggguuuguuuuauucauggacuuuuugaaaaaaaaaucacugguuuauuggaaaccauagagaaguauaaguaauuauuaugcuuuuuaaaauacaaccgagguuccucaucaugauacguuaagggaaaggaagacagggcaggagggugguguggcacaaaggcggcucugucugaccugucacguuaggacugaguucauucuuguucagauucagcaucuuuuguuauacccgaagugcauuccauggcccugucccagccauagaaagaaaugccuuuauuuuuaagcgagacuucuuguggaaugaugaauauguucagggaggcuguugauggcaagaaaagaagggugauggguugggcuuauauuguuuaguggagcaaaacagaugugaaacauuugugucuuaaaguguuuuggucaagagaaacuaaauugguuagaaagugugcaauuuugcaagcuuuauaaaaguauaaaccaaugagucuggacucuguucccuaaaggggaugaggaaugaaaaugaagguuugcaaagacaucuugccagacccuuacauauuuuaauuuaaggugguauuacuguccucauuuucaagcugaagaaccaagcucugagagaguuaaugauuuucuccagaucauucacauucauuucuguuacacagcugggauuauaauccaugccugucugacucugaaaccuauuuucccaucuuuuuuuuuuuuuuuagggauaaauuucucccaaacuauaugcagauccugcuagagacugcccaucccucuauccauuucucaguuugaaaagaaauccuggaauucagaaugaugaauauucauuuuaacaucaucuuaaaauguccuuauagauguauauuacagcuguagucugccaggccaagaauucgauuggcauuuccagaguacuguugauuguauuuuagaaucuuccaaaccuccguaauugucuuguugauuucaaacacccugagaacauuuccuaaaugcucauagcguccaauagcaugggaaaguaaaugguuuaugaggagaauuugggaugugcaaaauaagccuuugaagagagugcauuaucugaagccugacauuguaacagcuucuuaauuacgcuuucuuucauguggcauuuuuaugggauccaguacgcccaggcucaaaugauagacauuucaacuccuacauccaaguguagggagucccaacuuuuugaauccauccguguggcaaauguagcuggacccuugggaugaagacccuuccugcauccucccaaggagacaaguucugggccauaacucuagagcaaccccaacccccaggccauggaccaagugucaacaauguugacauugugaaucccugaucuggaggaacauagcuuuggggcagugccaggauuuaauauggguucuuuggacuucagagccccuugugcuaaauugaaacauuaugguguugcuuugagcaaacaauuagcauuuuugccauagcuuuuuacuucuccauguugaaauuaucaaagauuaucgucgaaggcgugguuucuuuacuaucugucuucuccaggagacugucaucucugugagugcaggaauccggcuggugguguuuuuacucuaacaccucuuucaguacauacauacaguaggugcuuaguagauguuuacugaaugaauggauaaacauguacaaaauuaugaucccuuguguuaaauaugguagggaagcaacauaaugugcccuggaguuucacagaagaaggggcuuucuuccagcuuggggauggaggugagcugucauucuggaugaugugauggggaaagaggaugugagcugaggcuuggaaccaagcagagcuugggcuuuggggugcugggaggacagaaugcuggaaacagagguaagaaggguaagcaccuagucaacaugagugauuuagcuuugggagcugaucaagugauaugauuuggcucugugucccaacucaaaugucaucucgaauuguaauccccacgugucaaaggagggaccagguggagguaauuugaucaugggggugguuuuccccaugcuguucucaugcuagugagugaguugucaugagaucugauggcuuuguaaguguuugguaguucguucuguguucauucucccuccugccgccuugugaagaagguucuugcuuccccuucgucuucugccauggugguaaguuuccugaggccuccccagucaugugaaacggugagucaauuaaaccucuuuccuuuauaaacuacccagucucagguauuucuguguagcaguguaagaacagacuaauacagcaagggagcagugauggagcacaggcuggaaaacugaguugaggggucagugguggacccugaagguuagacuaagaaauuuagacuccagccuacauaaauuuagacuccaugcagaaugacuggauguccuauaggacaugcaaagccacagggaauuuuggaacaggaaauugugcucaaagcugaauuuugaggagguaaauacagccucuguguguaagacagagaaaaggagagagugggaaguaauuuauguaucacaguugccuagagaagacagaaaauaggugccuggcuuauguggccacugcuuuuuuuuuaaacuuauuucuuuaauuuuauuuuuuuuuaaauuaggauuaaaaaauguacauauacacauaaaauauuuauuuuugaauagguaauacuuuuauaugguucaaaaaucaaaaguagaagauaaaaacaagguguauauguauauauauuuauauaccuaugugcauauauaaaauccuuguauacauauacacacacacaccuauguuuuucuuuauguguguuaaaaucucccucuaccccuuuccuuuagcaccuaauuccucuucugaaccgauguuauuuccuggugcauccuucuagacauuauuaugcauuuacaaggcaauauguuuguauauucuucugcccuccccuucacuuugcuauacacaccuugcucuuuuugcuugacaauauaucuuagagaugguucuaaaucagcauauaaauuauuucuucauuuuuuaacaacugcugaguauuacacuguguggauguuucauaauucauugaaccaauucccuauugauagacauuuggguuguucccagccuuuugcuauugcaaauugugccgcaacguguaaccuugcaccgacaucgcuucccacgugcaugcauguauuugcaggauugagucuuagaaauagcagcaucggcugagagaguaugcacuccggucguuuucauagauauugccaaauugcccucuacggagguuguucugauuuacauucccacuaagcaacauacgacaguuaggguggcauuuccugacuccaugcuuuguagcuggguggagggguggacugagaguacauguggaugggaaggugcaagugaaugcucucaaaaugugcuuuaaggagaaauauuuuguugggacacagaaguuagacugcaagaaggagaagauuggauucagggcaggaaaucaguacaacuugcaguaguccacaugacaguuacgcaaaggccuggucugauagaggaacaagagagagagaaagugcauggcaaagacccaucauugaugagugacuggaugugaggaauggagcaggggagaugcugaugauuugguuacccccuucuccaucccccaccacccacugauguuauuauccaguaaggaccaggagagaagaagagauuuaagaagaagacaauggcugugguuugaugaagauaaaacgcccugccagaaucauuugagcaaaagcuuaauguuguuuguggcaaugucacuuacuccugaucccauuggagaaaucuuuccuaucacuuccaauccacguguguucagacaaacacuaauuuuguuaguacaacguccccuaauagcuaagaguuaaaaaaaaaauaggucuuagaagugugaaaaacaaaaaacaaaaaacaaaaaaaaaaacacuaaaccccaaauuuguccuuuuaacacuuucagcaacccuguaaagucauuaucaucccccuguuacagguaagaaaauuaaggcucagagagguuaaauaacuuggccaaggucacacagcuauuaaggaaugguaccaugucuuggacccagguuaacuuuaaauccugagcuuuauaacgguuugauuucaguagcaaaugcaguggcacagaagggucugggcauuuauuuccaaagaaugauuucacucaacugaggaauucuaauguuuuaacagcauccuacuuauuucuaaaguguuggggugaauuugccaagguuugaaaagugcauuuguaagccaguaggauucaaucugaagucagggauaacagagccgggggcggaggcuaggucuccuuacauauuuuguucacaaugggacuagaacacucugcagaguaugaagguugugauucaguugcccaagcaguaaggccugacuggugucacgaucccacaacccgcacaaaggugccauuguugcccagugugaagggagcugaggcaucaccaaagggggccaagcgucccuucucuggguuagaaauguuguuuuccauuugcugguaaacaacaguccaaguucauuguccugacacagaacucuguuucuucuuuuaugcugagaguuugcaaguauggaucuugauaggaaugcuugcaaacaacgguaguuauaaaauguugccuccuguaucucaguaggcacuguucaagcauuugaacuucaucaaguaucaagacaagucuaagagaagguggggagagaccaucagggccuaggauuggaaaaccuccaacgcaaaauagagauguaguuuuagcgugcugcccaauauuaaaagauuguauaaaugaggggggcacacuuccugauauguucguuaugcacauagucacacaccucucagugccuuaaaauuuguuaugaugcagucuaucucguauggaacgaucuugauguaucuaucaaacacgggagaaaaaccacuuaaaauguguaaaaaguuuauuaauaaaggaguacaugauuguguuuuaaaagcuacauacauuagguuuaagcugcagaaaauggcgguuuauuccgaaagacugcuguauuuaugcuuaaauaauuaggauuaccucuaccugguauauuugcagggacaagcaaagcauacacugaaaauaaauucucaaaugaaauucauuucacauuaguugcaucccaacauuccuuuauggacugcauuccaugccuggcacugugccuaugauuuauuaaaaucuaaagccauuaauaaauaaauuauucaauccaugcauugaauuaucuagcucauucaaagacagucacaguccaucccucaaagagcucauggaccagucgaaggagggugacagccugggucaaauuggugcugagcacacaggcaggggucaggcucccuggagugaaguguaagcgucgcuguucacuggcugagucaucuuugguaggucccuuuaccacuuugccacuuuaagucuccguuuccucaucuguaaaauagagguaauaaaaacagcuaauauuuacagagagcuuacuccuuguuagcaguuuucauuaauuaauggguguauuuauuggaauaaccguguaagguugccauuuuuauuuccaucuguguguuacagaugagauguguaauagaaagggaauuugcccaagcucacagucacaggcugguggaguugggauuucaaacccagagugucugauuccugaaccugugcucuugucucuuccuucaguaccacauacaacagaggggacaaaauaauuucuauauaaagugcuuagcauagugccugccacuuagaccucaaaauauauuguuuucauuggauaauuaaauauaaaauaacauacagcaugaugauuaauacaacuaauaaauagugcauuaguauuauaggcacaaaagacaguaugaaguacagcacagaucaugaggaggguagggucaguucuacguaaaaacaggguuaguaaaggccucagagagaagauguccuuugagcugagucuugagacuccagagaucaggacucaaggacuguggaaccuguacauucacauccugguaaucuuacauugcucagaagacuccagggacauugagguugcccccauggaguugaaacuccuaugcugaucacuuaggaagccaagaacaaauuaacccagggcaacaagaaacaaugacuaauuagacccuaaugaagugcugcgguacuggcguccuuccagauuugacuuguaaucgccacaauguauuacagaugcagagucuucaucuuguugggcugugaucaaguacauaugcuccccagcaguucuuugagauuuccauguucuccgcacagugcggagcuacugcgggugugugagccaagggggcccugugacccuugaaauagaaaagggggaaauggcugcaugccaaccgaagagaccacugcauuguuggccauaagugaaacuagugagaugugugggauaucauaaaaagaacauugacauaauccuuuuuuggaugaaguuauaucacaaccagaacacacaaugaccagcaggcuucucuuuuuuuguuugauuucacuccugaaaagugggcuuucugugagaguuggacagacuccaugcugccccugccucccgggccuuccuucccaagcagggaugagcucuccucugcauguaacaagcaaggugauucagcaagaagacugcuggucucucccuuccuccagggccauuugugagagugagacacaaaauauuagaagcaaaagaagaagcuguacucccaagaggcauggauccuugagugaguuaugugcuuggaaaaaauuaguuugcacaugaggacacaaagagagccugaaaagcaggaggcuuugaggucuuuuuuucccuccugauucggagggaaaaaaaauguuguuuguguucauuuauggaaauuagaucuaucacauacucuuaugcaauuuaugaaauguuaagcaauaccccugaauguccuagucccaggaaaguugagaguugagugcaagacggggacacccaggagccaguaaaucaacucuugaaugaugguguauuaagugauaaccuugucauaguuaaagucacacuggaaggauauauauugaggcuuuaucucugccauggugucagcaucagugaauuaacacagggugucuuaacuuuucaaaaacaggacaugggugaucaagcagcaguauaucucuuuacuccuuguauuaguccauuuucacacugcuugauaaaaacauacccuagccugggaagaaaaaucgguuuaauggacuuacaguuccauauugcuggggaagccuuacaaucaugguggaaggcaaggaggagcaagucacgucuuacacggauggcagcaggcaaagagagugagcuuguucagggaaaccccuguuuuuaaaaccaucagaucucacgagacuuauucacuaucaugagaauaguacaggaaagacccacccccaugauucaguugucucccuccaggucccuuccauaacacaugggaauuaugggagauacaagaugagauuuggguggggacacagagucaaaccguaucacucucccacccaacacuugcagaaacacacacacacacacacacacacacacacacacacacaccccuuccuacguccuacaucccuguacuuggaaagcaaucauauuuaaaucauugcugcuggaacuuuaguugacuuuauaaguuacauuuuacauaaaaaggcagcaguggugaagcuggaagagggcaccuaggcuuugauuucaggcaagauuuuguuaggucccaguauugggacuuccgguugguggauuuugcucaagaauaguuuucucuuugucuaacgcuucaugagagacaaccuaaauaaagccacagccaguguuacagaaauaguguuucgugauuaaaauaaugguacuuauuugggagaguuacuugccacguuucagaugauugggagguagucuuuucaggaauauucugaguuuguuucuugaucucgauagcagcaaccuuuccauuugcucucugucugguuucucugugucucucuuuuucccucaaacaucgcuuuucuuuuuuuaaaacaagaauaaaucccuuaggaccuugcuaaguuauuacuuauauugucgcuuaaaaaaaacuuuggaaagaggcucuggcauacuuuaaaaaaguuaagcacacucaagccucuuuaauucuaaauucaguuuugaauaugcuuguacugaugucaaugacuuuucaaaagagagugucccaauuauuuagguggccaagagaaacagcuuuaauucuuuaucacauaaauaugcuucaaaccacgauuuaaaccagauggauggagcacuggauuagugguggggcuucuuggcugaucugaguuucgccuccucgaucuugccugggucuguucugucacuuggaucuuaccaguccuggcaggcacacagcucugugagauuuuccuucuggcuuugcaugaagcuuuugaaaagaaaacacauacaugcaagugaccuuucuaggguuguuucuaguuucuucgucuuacauaaagccccugcuaauuuagcauggugugugcccgaguuuauuuucuuuuuaacaacuuuauuuauguaauuaagcgagugaagucauacauuuuauugaucuaaugaaacgcauuucaugguuccuccugcccuucaucuucugaccuuccccuucagaucacagcccuuuacuuucgucaaugagacgccacuuaacaauuuuccaccuugccaaauuugaggucccccucaacauuaacggggaacccaauaucaguuccuuaaaugggagcaaagauugaugucaauauaaacuaugacacacauucauauugcagaaaggguaagaaauccuuacacagaacgaguacggucucuaacaguaaaguacagaacaggugguucucauuuuaguauauuuaaacuucagguccuuaaauguucuuuucuuuuuccuucauucuguuucuuuauuauuuuaauggagugcaaggugcagucuuuuugaagauguagaauguggccuuauaaaagcuaagugcuacuuuauauuucugcuguccuugccgguggccugcacuggggaguuguauauuguaucaguaauuuuaaaagccagcaaguguucuaccagcugaagaaguuuuccuaaugguggcuggucaaacguauuacuuaacuaggcguauagaauugaggggaaaugcaggauguaaugaaaugacauuggucaauccucaguaaauguuuuuuucaaaggcuuggcacaaaaaaugugcaaaaucuuggagguagauuuuuuugggggcauuugucagggaagagauuaauauaauacucagugaauucaggcaaguccucaagaagaaaaauuuaaggagcaaauaugugagccaggaucucaugcuggacuaucuaagcaagcauguaggaagaguuuguuucuuccugcuauggccauagagguuugguugucacuaugaagaaugggccuguguuuuuuuuuaaaaauaugcugaucugggugaggucacauuuugcuauucucaguggagggaauaauugggauuaucuuaugauuuuuuuuucucuuuaauuuucuuacaaaggaaaaagaaagaauccaauuuguuauaaauaacugcugagggcaguacauguugcagguagucacuaucugggacugguggcacaggcaguaaaggauucaccaagacaguuguagguaaagaaagguggauuuauuggagaagauaagaaaguacacuguaagguugcaacaggcagcccagcauggaaggggcugucugcaaagaggcaggggcuggagggacugaaguuauacaggguccuguuggagggagcuaugugcagaaugaggucgaggucauugugccugcggauuguuuguuguucuucccuacccggggcccacuccuaccuggggccucuuccucauugcugcuuacuuauuagaacuccacaguagauuuuuuauaaaugcagacacauacagacacccacacccacacauacagacacacacagaaacauauacacauuuaggucgcgauuucuucacaaggacauucuuauagacaugucaugaagggacuuggggcucagagaaaugaaguaacucagcuaagucuguacaguacuuagccaggggauuuagaaauccacccagggauggcuccaguugccuguuucuuuucauuugacacgggauggccuaauggguccccaccagggguggcuuggaaaggagaaagcaacugcauucccacuggaagguguucuguagcaaaguggagugaaugccaccaauaaugaguuccaaacaggguauguguuugcagacaggagcuacauacauuugaaaauuaggaugauuugaaauugaaaugagggcuuaugcuguucauuggauuaauuuuucucucuuauaaauaaaaaauauauacaaauaauacauaaacauuguuuuucacuguggcuugaauuuucuaacaauuuuuuucuucuucucaggaaauguuuucuucuuauaccuccaaaauaaccacuguugacaguguauuguuaaccuugcuagaaaaaaauauuuauuuuugauccauacacguaaauaugcauacucauaaauaugcauucauauuuuguguaugaguacacuuguuaauuuacauguaugucuugauuuauauacauuguucuauaccuuuccuuuucccauaauuuuauggauuacauuuauuuucauuucuguauauuuaguuaauucuuuuaaaaggcugccuguuaucccauugucugucuucaccaucauuuacuuauguaauaaaucuguuaaauaauuuuaauauaaaucuauucaucuauccaucuauuaaaagagauuuaaguuauuucuaaucuuugcauauuauaaguugcauuucagcuuauaccuugacuuucuuugacauauacaucaauagguagaguauauuccuagaaauucaauuguggaccaaugagauguacuucaaauuuuuaacagauauuucaguauugaccucccaaaauguauucacacacccaccaaaucuaagugucuguguaacacacagaugcugauuuggaguauuaccauuuuaaaaaaauaauauagcuaucagucguguaaaaaaaauccucaccauuauuucuuaauuuuacauuguaauugugagugauguuggguagauuuuuguacuuuuauugaccauucacauuucuucuuuucugaacugccuuuccauauucucgguccagcuuucuauaagauugcucucauuuacuggugagagcucuguguaaauuaaggaaaccaucaccaccuucgaauggcugacuauuguaaauauuuuaauguuugucguuuguuugcaaccuuguaauuuuuuccugugcagcaauuuuaacuuucuauauucaaauauacucugaaugcacagugaauuuggcagaauaccauuuaagucuuguauuuuccaaagcuagucaacguccaacugccaauguugccugaacaggaaauauuuauaccugaaagcguccaggugagagucaggaaagccaugaaggugcaacuggcauacugaugucacuucuucuuuuuuuuuuuuuuuaagacggagucuugcucuuuugccaggcuggagugcaguggugcaaucucggcucacugcaacauuugacucccugguucaagcgauucuccugccuccgccucccaaguagcugggauuacaggcaugcaccaucacacccagcuaauuuuuguauuuuuaguagagacgggauuuuaccauguuggccaggauggucuugaucuccugaccucaugauccacccgccucggccucccaaagugcugggauuacaggcgugagcuaccaugccuggcccugaugucacuucuuaggcuaauuucugugaaauugugauugggaggaaaaagugaacaggaacuuaaagccagcagaggaaagcuaccugcccuucacugguggucagugcauggauuccagagacagggugggcaccaguuccucaccggguccuuucuaguugcaugaccuggggcaggugacuuuauguggcuaagccucagcuuccugacauauggcaggaguaauaauaucccuugaagccaacaaaauucaauaggcacaugccauguacaugccuguguuaugccgggaacuucuuaacauuuccagaauauguguaaucauauuuguuacaugcaauaugaaauuauguguaaacuguccaaccugcaggaggcaguagaucaaucaauuacaugugauuaauccucccccuaucuuacagagaauaggagagaaaauagagcuccaagguggaggaaaagacaacugagaggaggcuauugugauguuuuauuaccauaaacugccaaggguuagucguagcccuccaucugccagcuaauuccgguuucauuaauaugaauauucucacgcuuccagaaggaaauucuuggaauguuauggaucucuguagcaggcacaugcaacguccagugcuucccugcugguaauguggcgguuuuauuaugcaugccauacccaugcucucuauuuccucgauagaccuuauagaaaucaccaugcuuccuuuuagaagaaaaugaugguaucacauggagaacgagcugaggagcuugacaaucuuggcaaggcuuaucaaaagaaaauucauguguuagccuuaaguuaacacuacuuuuauuaaauucaguuuuuaucacagcugauaacuuggagauguaagcauuuagagacagaauucacuuaugaauguucuaaaaugucagaaaguuuaggauucucuucagguaguuuccuuucucucacuuggagugacauguuggacccguggcauugucccgaggcaacguuguggaauuuuuagagaguguuugucuguuagcuguuuguuuugaacauguucaccuuuggcucugaccugccaucauggaaaaaaagugucaauguguugggaaagaaaugggcugcuucucuuuucuccucccuccuccgucuccuucccccgacccuccuccauccccuuccugcccccacuccuccugcucuccagccuggccucuguccccucuguguuccuccccuucuuccuuguauccuuaaugacuuccaggugugccugcugggucaggcuucuggccccguccuggggaggcugggucugugccuccacaaacacaagaccaaaguuagggggugggggacuccagaaguacaacaucagaggaagaaaaaaaaaacuuugaaguuuugaggaugaaauugguaaaaauaauucuagaugaagauagacccguuuacauuccaaggaagggaaauguuuuacccaaacuguuuccauggacccuguggguucuuguuaauacuguucaaccuugugauugaaagcccaagcccugugauccacagcaggggccacagccagaaauaauuccccgagaauacugcgugugccuucaaaugguccuugaucauuuuucuuggaugccccacuuuccaaaggccagaaauuguuucagggagucauuccaguuggggaagguuuuauguucuaagagcaaggugcuguacucauaggaaaauguguaauucgucaugauccuuuuguguggagaggauggcggugguccacuucucaacuugggagucccuuagugacucaugauguauccuucaguacgcugcccagugccuuccccauuugacuuagauuuucugccacaguuuaaguaucaccuccucuaugaagucuugccagacacauuccucgucucuuuccuguuggaacaacugccucacuccuguggccccacugugccauagacagguuagagaacaugggcccuggcaucagaccuggcaggcagucuugauuaggcccguuauuagggugcucugggcaaguaaguuuaccugugccagggaugcaccuuuuuaacccaacacuuagagggguccuccauguacagccaugaucacaacucucuaacguggucacuugcuugcacacacuuguuuagaugucucugcccugcuguuaauuagacugugagucuccagagggugagacugacaucucauuucucuuugcagucacagcagagaugcaggcccacaguagggacucaccagauguggcagggugagggaauuguccauagaugccuuaaagauaugcuauccacaggagcagagagcacagcaggcuggaugccaaggagaauucgaccaggguaaggcuuacaggcaauccauucacugcagagucuucccccauccacacauauaacucccuuuaguauugaugaccuuucucuccugaaauauuacagaaacugcccugaacgaagauagaugguccccccucagcguucacacaugguuccgucucauccaccagcuuccccggccccauucccucugucucaggaaaguaauaauaguaacucauaauaauaguucaaaauaauaauaaucauaccugggauuuauauuucagcgugccuccuaagagggcaaauaaaccauuuuacacaaugcagagagaaggacagauuuucuuugugcugcugcugaucacguuaagccaggagagauuuacagucaaauuccagcuacagaagcaaaguguuggugccccguuggcauguggggauccacuuuaauguuguucucuugguuuugcuuaaacugccaagugaauuacuguaacacacuuugccugcaguuaauuugacaucuagugccagagagcugcuuuauauuuuucaaggcaagccagggugaaauuuuugcaaaaagauuuguccaucauuuuuacugauguccaaacacgaugucuuuagcuucuuuggaaucgagcuguggaagucacgugggcuuuuucuuuuuucuuuucuuuuucuuucuuucuuucuuuucuuuuuuuaaggaucacagaagaaaagcaggccgaucuuguugaaauguuuuuaaaaucuccaaauaauaaaauagguuuaggguguuugcuuaugaaagcugacuuucaccagaaugauuuauaugcaucaugggcagaggggcaguccaauaaaagaggcagaaagggcucuugaaaaaugucccugggcacuugcccgaaugacuuuagugacaguaucuacuaaaacugauacuaauucuguuacguguuauggcgcauacccaagacccuccccauaaacuauuugaaagaagcaaaguuguaauucuccaaauacggacuuguacauuucugaucauuuuagcaccaacauugguucaaacucuggcagccgaccacaguuccagcugagcuuugcugcgcugucagcaccauggggccugauaaagcauuuuuggauuuuuccuacucacagugcccccauggucucaaugcuguugagaacauuaagcuccuuaccuguguuuugugguuguuguuauuguuuuucuuucugguaaaggacuuuaucugcaguccuaacaaauugacuuacguuaacauucuaacucguggcuaaaccaaaaauaaacuugcagacccugcccugaaaugcacgcucugagcagucuauuggaugcggugguguggccgauuucuuggacuugcuacauucuuaggcaagugacaucucccuucauuuguacagagggaguuagaauugaaucgaacuuccaccgcagcauccgccagcucuuauaaucacuugcccuuugcugauggugaguuuuuagcugcuuucucuccuaccauacagcacugacaccugagaaguccaguccuuuuggaguucaguagauuccuugucucuggaaaaucagcagaaaacaaugcagccuccucuugaucuccccugaacuuugcaaaccucucucagcauugaccgcaugaagggugggugcccugaggcaggcaagccaccaggugguaauuaagaagcaagaagcgcugcucccaauucucuagaucuggauuuagaggccaguuggcuucagaaaacaucucauucacacaaaaugggacauggucuuuugucuguuaaacauaagcuuucaaggugaguugugcagaggcaagucugcuuguuucaucaagcugacguuuauacuucugaguaaguagggggauccggagagucuucuugucacucaaacaguuuccguacgucaguuucacaccucuguucugcaugucucuguugggaaggaugcugaugucugggauuugaaauagagaugguuggaccucugacuuucaacaggaggaaaucaaaauuaaaggaagaauauaggcguacgcuuagaaaggaccugugaaaggaagauaaaucuugggcccccaaaucacuaagcuaaagggaaaagucaagcugggaacugcuuagggccaaccugccucccauucuacucgaagucaccccucuguucacugagauaaauacauaucggauugccuccuuuggagaggcuauucagaaacucaaaagaaugcaaacauuugucucuuaucuaccuaugaccuggaagcccccuccucauuucaagucuuccuaccuuugcucugaguugucccaccuuuccagaccgaacgaguguucaucuugcauauguugauugaugucucaugucucccuagaauguguacaaccaaacugugcucugaccacuuugggcaugugucaucaggcccuccugaggcugugucacaggugcacauccucaaccuuggcaaaauaaacuuucuaaauuagcugagaccuggcucagauuuucaggguucacagaccugucaacaugaacugucaguggugauagcacccguuuucaagucucauuuuaaucggaaggaaguuuuaccagcucuuuggcuuuguagaaggucgaguucuccaaauuuaagagauucaaaaauguccuccaaagaaguuuggggugaaaacacaugacaguuucuuguucauauuuggccagaaggaagcaguguccauuagguugacucuccagugcuucuugguguugugauaagcccgucuagcacggagggccagaaggaagcaguguccauuaggaugacucuccauugcuucuugguguugugauaagcccgucuagcacggagggccagaaggaagcaguguccauuaggaugacucuucagugcuucuuggcguugugauuagcccgucuaacagggcgggccagaaggaagcaguguccguuaguaugacucuccagugcuucuuggcuauugugauaagcccgucuagcagggaggagaugucuacacgguguucuccaaacugcucagaaaagagcaguaaggacaggauggggcccaguuaagagguauauaucuuaccuucucuuuuucuccuucuucuccaucuccugcccuuacuucuuccugccugucauuuauuuauucuuuucacagauauuuagugaguccuugcucugugucaggccacaguguagauauuccagggauggaggugaccaagcagacauggccauagugacaggcuaaggaagcacaaaucacaaauacagaagauaauuccugguagugacgggugccuccaagcauauaaaacaggguagugagaugggaaguuagaguagaaauggcucaauuuugugcuggaacuggcugcaccagcaggagccaaugauuacccaucucccauguuuagugacaucauguugauagcuugauuucagccauagugagaauauuuucaccacggaaauuggcacaugcuacacaucagggcucccuccuccccaccaaagcugaucauuaaacauuuucuagaacauaccuggaaggcaucugggaagagguaacauugaucuuaauuguuauuagagagaauuuucaauuucaguuguagcaugaaaaaucacagaguccauuuauuucuccucuucgagucaguauaucucaaaacauuuuuucaacguuaauagaaauauaagaagugccuggaucaguuuuuguuuuuguuuuguuucuuuuugagauagggucucauuccguucccuaggcgggacugcaguggcaccauuaugguuuacugcagccuugaccucccaggcccaacugauccuccugccucagucucccaaguagcugggacuacagggacacaccaucaugcugagcuaauuuuuauauauauuuuuuuacagagacaaguucucgccuuauugcccaggcugaucuugaacuccugggcucaagccaccagccugccucagccucccaaagagcagagauuacaggcgugagcuaccacacccagccauuuaucuguuuuuuaaauagcauuuuggagaugacagaaaaaaaaauaaaggaaagagaacgcucauagaaguuuaagguucagaaguauuuggcuuugaaaaaaaaguuuaagggacuguuugucauggggucuggucuuccaaauuuaaugccucauuccagguagcugcagauuuuauaguuucucucaaagaaugucaauccuauugucuuucccugcuucccccuccuggaugaagucuuucucuacacucuuuuuugggaaguucccaaaucugucaguauauauuacaaaaacuguuaccgccuaacacauuaaauguauuuaaauuauuuguucuauuaaaaugucaguguauuucuugaauuuuaacugugccugaagaucaaucauuguaacagcugcagggaaggcuuuaugacuuaccugaacggugguguauucuguggcucggcuaaguggauucuucgacuuuaauagauuuuacuagcuaggacaaaccauuugaguggcuucuguuggaguuuuauucuugauacauaccaaugauuuacucagauccguuagaaaaaauaguuuuagggaugauaaaaauuaugauaauaauauugacaauaaauagaguauucgccaauauguauagagugcccauuauguuucacacccuaugucuuguguguggugacucauuugaaccuuauagcagcccugagggauaggugccgguuugucucuaugcgcccaugggaaacuggggcacagagguguuaaguaagugacccaagaacacacagcugguaggaguuuuagccaauauuccagucucgaucugcugauaugaagccgaugcagcuagccaccauguuauacccacccauagucaugaaaauaagaugagcuuaauuuuuuucuuuugagacugggucuugcuauguuacccuggguggagugcaguggcacagucauagcucacugcaaucuugaacuccugggcuccagugauuuucagcuuacugaguagcugugacuacaggcacaggccuccauacccagcuaaguuuauuauuuuuugguagagauggaguauugcuauguugcccaggcuugucuugaacuccuggccucaaagcgauccuccugucucagccucccaaaguguggagauuacaggcaugagccacugcacacagccaaggucagcuuuuucacuucagcacaccaggauuuucaucccagcucuccaaucccccagcugugugggccuggucaaccuguuuagccugucaagacuucagucccuucaacugauagaugggagaaauuaauagcaccugccugagaaggccagcuuuuugggggacccaggaguuacgaaugcccagcacuucucaggugauagcugcugcuuaucuccuuguacagagagaacuggaacauucugaagaugaaaugggauaauaauguccaugaaaagaccuggcuucacgcuugccuccugcuaguuccuuuucuacucuauuucagcuuccuguuuguaacaugauuuaagcacuaagcuauugaauuuuggagugcauuaaaaaaaauaucgaguggaaaaaggaauauuucuuagggaggaaaaacccgacuuuugacuuuauaauauuaaguucguucauaucucucuuagauucuuauauaaauuuuauugaccuaauguucuguacaguaguccuuaauuacaguuuugguuuccaagguuucaguuauacauugucaacugugguacaaauauauuacuuacaauaugauauuuugagagagagagaccacauuuauguaacuuuuauuacaauuuauuguuauaauuguucuauuauuguugcucaucucuuacugugccuaauuuauaaguauacuuuauuguagguauguauguauaggaagaaaugaaauauauguaggguuuggaaccaucugaggcuuuaggcaucuacugggggucuuggaguauauccccugugcagaagcggaggcuacuguacauaaauuugccuguaagugagcgcguucuuggauuuuguugaauggugccacugauuaugggucagagcuuguugaaaggguauuaauccauuauuuacuaaaacuaauuaaauuuucaugucauuucuuuacuuauuguuuuuauucucuaucaguguaauuuauuacagcaaccaauuaaagaacaauuuuaugguucuaucagugaugccaaaaaagcauuugcucaaauucagaagucgugauaaagccaaccaaccaacgaaacagcaauacuuguaacuaaaauugggagaaaggaaaacacuuucaguagagucaaggauuuuuuuguuaauuauuuuuauuuuuagagauggucucacuauguugcccaggcuggucucgaucuccuaggcucaagcaguccucccaucucaaccucccaaaguguugagauuacaguuaugagccaccgcauccagcccacaaauauuauuccaaacuguaaaaucgugaaauguuuuccauuagaaucagaaacuagacaagaauauucaugauagcugucaauugucacauuauuuuagaaguuuuaacaaauacaguaagacaaaaaaagucuuaaguaaugggaugaaaccaaaauguucuuuguuuuaaacuucuguaauuauaauccuagagaagcuaaaauauucaguaaaaauuacuagcaaugaaauaauuugaagaguuggcuagauguaagguaaauauauacaaauuagcugguauauacuaguuauaauuuaagauggagauagaaaaaaaccccauucaaaauauuaacacaacuaucagauauuuaagaauaaauguauaagagugaucaaauaccuguauuaaaauuauauaauuuauugaaaggaauuuuuugaaagucacccauaaaaugauauaauuuuaccauaaaauaucagcuaaaaagggggcagucagcaaaagcucagcugugaauuaagauuauuuucuaacccuuaguucuuugauaacauaaauaccgguagaacuuggaauauuucaaguaaaguaacaugcuguguuuuaucuguauuccugguaacuugcauuuuucaaggaaggaaguguaugauaugaaguaggcuuauaauuuagucagaugagcucuuggauuauguuaccuugaauauaaugcagaggagaaaacaaaaagagucuuuugcauuuuuauuucuuaucaauaggucccuuuuucuuggaaugucagccugacccugaagguauucuccuaccagcagagccuucuuugaugccccgucuucaaccugccauguuuucccaucucugaggcuucuauuuuagagacuuuuccuccagaacuggcuuauaucauccuguguugcugcauccgaucacaggucuguggcugaccugggcagcguaguagaagggucuugagauuuggagucguaacgaguuuucaaaacucauaacuauauuacaguuugcgcaagucauuuaaccuaucugaagcuucauuuccucucccacacaggauaaaauaaggauaauaacagccauuuuagaguucguauuaauauuuaagugggagaaugcagccaguacccugagaauuaagguucauucacucagcaagugcuuacuaagcaucugguuuauauuaugggaaguuuugagaauuagguggucagaaaggugugguccucgccuucaaggagcuuacauucuaggaagcgaagacuacugaacaagagauuuuagugcuaggauuggagaccccagcagaaguagcaaauacugugugagguuuaaggagguuggaggcaccuucgcuuguacuucuacaugugucccuucaugucuaguucacugauuuuuuaauugaaauuuuaauugaagacucacauguaguuguaagaaauaauauacaaugauuccucauauucuuagcucaguuucccccagugauagcuuuugcaaaacaauugugcaauaucacaguguugacacuuacagaaucuauggaucuuauucagauuucucauuuuaccuguacucaaguguguauaugugugucugugucuacauauguaguuuuauacagugucaucaaauguguagcuuccuuuauacacaacuacaucaagacagugaacagugcaucaccacaaaauucccuugcguugccuugcaaaccacacccaccuuccuucugcgccugccucaucccugaccccuggcaaccacuaaacuguucuccacuuuuaaaauguuguuuuuucaaaauuauuauauaagcagaauagcauaguauguaaucuuuuggggacugacuuuuuucacucgguacaauuccguggagauucuucccaguuguugcacgugucgguagcuuguuuaauuucauugcucaguaguauuccaugguauuguacauauaagugaucguauguuuaaucacucucccgcugaaggaaaucuagucuuggcuauugaaaguaaugcuauuauaaacauuuguacacaaguguuuguguaaauagaaguuuucuuuucucugggauaaaugcccaugaaugcaauugguggguuguaggguaaugacaugauuaguuuguauaagaaacugucaagcuguuuccaugcuauuuuacauuuccaccagcauuuggugaucuaguuucacuauaucuucaccagcauuuggugguguugcaguuuuuuauuuuagccauucugguaaacauguagugauauuucacugugguuuuaauuaaauugcccugauagcuaauaauuuuaaacauauuuucauuuguuugucaucuauauauccucuucggugaaaugucuauuaauguuuuuuucucauuuucuauuugaauuguuguauuauuguugcauuuugaaaauucuuuauauauucuaguuauugguucuuuguuggauaugugguuugcaaauaucuucucucaaucuacagcuugucuuuucaucaucuuuacauggacauuugcaaaauaaaaguauuuaguuuuaaugagguccaauuuaucaauuuuuccuuucaucaacugagcuuuuguugccaaaucuaauaauucuuuggguaaccauauaucccaaauaauuucuaauauuuuuuuccuaaaagucauauauuuuugcauuuugcauguaugcccaugauaaauuuugaguuaauuuuuguauaagaugugagguuaaggucaagucuaauaaauuuugccuaggaacaucucauuguuuuagcaccauuugcugaaaaugaucuuccuccagagaauuuuuuuaccuuuauucaaaaugaauugagcauguuuguguggguaucuuucuggcuucuuuauuccacugaucuaugugucugucucucugacaauuauacgcugucuucauuacuauagcuauguaguaagccucaugucagguagagugauucuucucacuguauucuuuuuuauuaagauuauuuuagcuuccuaagaccugugcuuuuucauauaaauuguacaauaugguugucuaugucuaccagaagccuugcugcaguuuuaaugggguuuaaaucuauaggucuaacauuaaaccuauagaucaauucgggagaauugacaucuuuacuauguugagucuuccaguuuguggacaugguauguaauucuauuuauuuaguauaaacccacuggaguguguaccuaagcauuucauuuucuuuggagcgauuguaaauggcauuguguuuuuaauuccaacuucuacauauaucuagaaauaugauugaguuuuguguguugaucuugauccuaugagcuugcugauugcauuuauuauaaaguuccaggaguuuuuuauuuuuguuuguauuuguuaguuuuuuugagauuucuugggauuuucuaucuagccugucaugucauaugcaaauagagaauuuuauuucuuccuuuauaauaugugugcccuuuuuuuauugccuuauuguaguggcuagaacuuccugugcuauguugaacaagaguagugagaacauccuugccuugcuccugaucuuagggagggggaaguuauuuaccauuucaccacuaaauuugaugcuagcuguaaauuuuuuguagauguucuuuaucaaguugaagugauucuucucaauuccuaaauuacuaagaaacuuuugaaaaugauaauggguguguacuuuuuaucaacugcuuuuuguaugccaaucuauaugaucauaugauuuuccuuuagcuuuuugauaugguggacuauauugauuuuaaauauugaaccagccuugaagaccuggaauaaaucccacuuggucauggcauauauguuuuuuuauacauuguuggauacaguuugcuaacauuuuguggauagcucaccaacuuuuauucagaaaacauccgucucaguuuagugcccaacaaggaaagcauacuguuuguuggguggguuccauuuuugugguuaggagaagaauauagcucccuuccuagggacggucucaaaugaguccccaucagccaccagggagcucagcuuuaguugcauaagaaccaaugagcauuuaguuucaugucucauaaauaaucugccugcuuauauuuucaucuguacuucucucagcuggcauucugccacagacuacauuuaggaccgcagccaguggguuacagcaggagaccagacuccaaguucuggccucacguugcuugguauacaucacucaguucuguuggcauggaugcuccuccuauaccccaucagccaucuugcaguauggguuugguggaucacacagggauucagauaagaggguucagauccuucuauccaucaacccacccauccacaucacugaaaaagggacucucagaugccgaugaccaguaagaccacaucugugggcacaaaagagcccauuuauguuuuuuaugggaaccuaagaaggaaaugcuuuucuggucaaauacguucuucucugauuaggccucucauuuuaaggcaguugagaagacucacagaugugauucacuggcaauggcucugguucaccaagcuuagcucugcucagucuaccuuuagcagaagauuaaaaaugaaaacucuucuuguuagagguagaagagauccuuucccaaaccauagauucauggaacugucaaagagcagcacugaacuuuguacucaaugccuuaauuuuuccaguugaggauaauucacacuaaacaagggauuucaccucucugacucaugcaucaggaacuuggagauaaagcccuguuaauaauucauaauuauauagcauagcauagggcaguuucagaugcuucaacuaccagguagguagaauaaaggaaugaaguugcuguguauacgaugauaaauggugcuaaaucuauguccccaauauagggaagacaggagaaagugccaaagauagugugcaugccucaucucuaaggggcagccauuauugacguccagcugaauguugccacguggaaauuagcuauaaacuugccagaaccuccaguuuuucuggagagauuagauuagaaauucauauauuuuuaaauauuaaaucaucccuuuuucuugagauggugucacgucguugcccaggccaccguuuauguuguccaggccacccuggaacuccuggacucaagugacuuuaccccuuuggccuccuggguagccgggacuacaggcgugugucacugcauccagcuuaaguuauccgauuuguaaaugguggcaaugaaaucauugcguaggccacuuggagugagccaaauaaaauacauccgcaguccagauucaaccugcaggccaucauucugcugucacugguguagaagacuuuuucagccuaguuuauucuaggcucuuuucauuucucccugauuugaggcuuuguaggacguugcacaggaauuauuucccuuuuaaacguuaguuuucauuuuaccagugcaacucugcuauuggcacaucuaugaaauacguaaagcuaucauuuuaauacuaaagaggaaacacaaauuugacucauuuccccagaaaauuccccuccugcuuuccauauguuauauaguuaacuguaaaaguggcaccaccucuuaaacagccagcuauucugaucauuugaaaucuggaacauucuuuccuacggugguugacuuuucacugccuuugagguucuuuccaaguaaaggcguuauucuuuguggugugcuccuggaggucacuaacaaaacgucuccagcagguguuguguggauucccccaaauccguaggcucuuauuuccuagacaugaagaguaugugcgccuucuuuuugguuacccuggaccagacauuccucagcacuggcuugcauuggcaggagguggcagagggagaggacaguaaccaauaccgcuccuucuacaugaucaguguucagguugaagacaaacagggcuccaauuauguugugauuuagaaggcgacagagcugagaccucacccucugcuuaugggcugcaugccuuucucagugaaauaacgcagaaugcagaggccaugccugcagaucaggggugcuagaggauaggcaagaaguaaguggccacccuaucucguguugagagcaugcuagucuccgaacggccugccagggugccugacagccagagccaccuaaugggccuauuugauccuggaguugcuguaauggcaagaaaauccauggccuccagccccaguguugaaguuuugacgcuaaugugaugauaauucucuuuucuuugacuggggacuugccuuuguuuaucuuuuuuuguuguuuuagccaugaaauaucacauguaaauagccgaggauaucugggcucugagucuuuaaaaggcaacagaaaggucucuguuacgaagggggaacuaguuuucauugucacuguauuaagcagaaguugggaaucauagaagaccuugaucuuaccauaucccuuguuaaauuuccucuaauacuauugagaaguuuauccucuacuuuuuccuguagaguaaaagauaucgauuuuguuucugucggcacugccuuggaacuugcuugcaucccucccccacgcgaggcgaggcccugaggagcgggauucgcugacccaugcuggcagaacgggugauggaugaggcagagaaggguacaggcuggcuggaccaugcgauggggaaugcagguggaacaggcuuccuccugaaucaggaguggaagaggagucuggggugaagccaaggggaagacaguuaagcuuuaaaaaaccaacugcccagccgggcgcagugucucaugccuguaaucccagcacuuugggacgaugaggcgggcggaucacgaggucaagagauccagaucauucuggccaacauggugaaacccugucucuacuaaaaaauacaaaaauuagcugggcgugguggcguguuccuguagucucagcuacucgggagguugaggcaggagaaucgcuugaacccgggaggcagagguugcagugagccgagaucacgccacugcacuccagcuuggcgacagagugagucuccaucucaaagaaaaaaaaaaaaaaacaaaaaccugcccugcccagccaugcccaaacagaguggccagcagucagcuuagugugggcagagcucagggaauuauucugcagugcagcuaacaucuagcaccuucuuugugucaggugggccagcacugggguggaggccgagacagcuugugagcucacucccugggagauagaacggaguacccaguugcacugagggaagagcagggauagaagugggcuccgggucuaggagacgguggaaagagaggacugcuccuagcgugagagugucagggaagcuugcugggggaaauacaaggaaggaagagaaugcaggcagcucaaaagagccgggcaaggagaccugcagagcgagcggaggccugguuucugugaagcacagggcaggaaaauccaaacucacuugaguacacgcucagggucaugggcuugcuauauuuuucauucaaccgccaagaaaucuugagaggcagcuuuaucaucuccaugugaggaggaggagauucaggcccagcguaguggcuugcgaaaagauuccagcacuaaaguuugaccccaguccuaccugacuuccuuucuccagcugugagacuccccuguacaauuuuucuggagggucuagagucacaugagucacgccaagccgcccuuucagugcgaaggaauccaagcagagcccuccucugcuguggguacuuacuuagggaacuguggagguguccucagguagccacugguguguggggucauaccaagucauuugguuuacaucgggaaugccuuuugucguuaugucuagaccccuggagaacagcccacggcaaugcacuuguggaaauucggacuguggauuacacugaguaacaauccuaauaauaccugcacacaaucaguugccuguccaaaaagcaauaaagaaccucuagauuuuguggucaccauauuaaucauaaauuggggaucauagaaggccuuaaucucauuguacauacuuuucuauuccucccaguaccauuuaaagguuagugaaagcaaccuuuaguaucaucuguuuuuugggggggguuuuuuguuguuguuguuuagcuguuuauggguaggagaaugcgugcucuuuuagggacaucucuucaaauaagaacagguuguaaccuacacucaaaagagaugcucuuggcaagguauggccccuaagguuugaaagcguuuuccaggccugcugucaggccaggcuggacuguccacaauuucuuguccugccucccgugaugcuagccauggaugcaccccagaagcauuuagaauuugggagaaaaaggagcaaggcauacugcccaaauccaaaacaacuuuggcucccuuuggccuccauucuaacaugcugaguggaugcaucauggauagucuuuuaaaaacaaguucucaucuauucaaugucagagcccuaaaugguaugaaaaauaggcaacuugggucaugccacuacagaucgacacccacuaaauccuuuuaauuuagucuagugcaacaaguauuuguguaaguguccucugcccuggacaccggugaggucaccgugggaauggcugggcaggaacaaagccuuuuguuuccagcugaguuuccuuuucugaagauugccuguccuagacaccaguucucuguucucugugacucugauuccugucuccucuucuuucacucucauccauuuucaauacuggccccucauuucacuuccucagcuaaaucuaccucucaaagauagacauggacauauaaauaauuuuuuaaaauccucuuuugcaaaaaaaaaaaaaaaaagaggugaauuuaguugaaaggauauagccacucuuuucugaagugauggggauauucgauggcaauuuuguguuuucuucacuuggaaaaacuaaaaaguuugcaacauuuaaaaaaaauacaacccuuaugcugauggauguacacuguaaaacaaccacguuugguaaacuguuaaucacuuucauaguguauguggauggagccaguuaaaccaguuuucaugucuuuuggguccuuuugagucugaagauaaccauuuuuuagguccucaugaaccucugagcaugaaccaugaaauuccuauuacaccugugcuuuuauaaacuugauccaagguuuaggcucucagugccuguuuccuguuuaauacauaucaugguuuuggaaaaaaugaaagaaagaaagaagaggaagagcugucauuccucugacaaguauuuucaguggaauuagggucaugaugucaugcuuauuucaaaagauagcuucaucugugccuucacccagacuuaggguucuagauucuucuagauucuacagcaggcacuggcaagcuuuugcuuaagaaggcaagccgggaaugguggcucacgccuguaaucccagcacuuugggaggccgaggcaggcagaucaugaagucaagagauggaaaccauucuggccaacauggugaaaccccaucucuccuaaaaauacaaaaauuagcugggcaugguggcgugugccuguaguuccagcuacucgggaggccgaggcaggagaaucacuugaaccagggaggaagagguugcagugagcugagaucacgccauugcacuccagccuggcgacagagggagacucuguuucaacaacaacaacaaaaaaggugggggggugggcagagaguaaaauauuuuagacuuugaagucuaagagacaaaauugagguuauuauguagguauucauauagcauuuaaaauguaaucauuuuaaaauguagaaaucacuuuuagaucguagaccauaaaaaaacagcaggaaaaacuacaugguuggcuggauuuggccaaguugacauagagagccaaucccucaucuccagcagggcuuuuacucaaugauacagugcgcaugaauugcuugggggauuguguacaaagugcagauuugguuauaggaggucagggaggggccucaauucuacauuccuaagaagcuccuaacaggcugauaauccauggaucgcauuuugaauagaaaggauuaugcaaaaagccagaguuuuuuuuucccuugucuuauaccaguggugccuagcauggugucagguuuauagaggacuaauacauauaagaaggagaaagggagggaggaggaauuccaguuguuuuuuuuuuaaucuagguacaagucucucuguugauuucuaaacaucgaaugaagaugaaggaaauacuuaaagcaccuaagcacucauaacucacuuagucauuucacuauuaaaagagaaaaauaguuaguuuacaauuuccaggaaaucagacaggucaccaccaccucuucaacgacuggaauuugcacagucucacuacucauaggcccaucuguuacuacuaacagugcuaaugugauugucuguaggucuagcaauuggagguuguucguuucuuugagacaaggucucacucuguugcccaggcuggagugcagugguacaauuucagcucacugcaaccuuugcauccugggcucaagcaauccucccacgucaaccuccagaauagcuaagacccaggugcgcaccaacacacuuggcuaauuuuugugcauuuuguagagaugggguuuugccaugcugcucaagcuauucucgaacuccugaccucaagugauucacccgccucagccucccaaagugcugggauaacaggcgugagccaccgcucccagcaacaauugcaguuuuuaaaggcagaaaauauuacacagguggguucaaauuugccacaccaaguagaagguguuggaaggaaaauuaggaauucuuaagcuucagaagauuaguagucagaguuaaaaaccagacaauuaacaaguuaaaaaaaaauugugaagcacacacagcuguuaucuuccagaaacacugcuuacagagguaauugcucacagauuuuaggguuuacagcagguaucacaggauuucaaauuuaagaggggggugggggccuguguucaaagucuuaagaauauccaagggauguaugauguaugcauaauuaccugaaauugaaacuacuguaguuuaaacacuugcugaaagaagaccuuuuauuucaucuucucuacaggcugaaggaaagaaaaaacaaaacuaacaacuaacagaaaaacuuuucaugucgaauauguagauuuacaauaugugaauuaucaucagaagaaugagguucuuugaugauuguugcagauacccugaagaacuggcccuuguuguagaagaauggcacagggcacaugguaaaauggcccuggccauuccuuuagacauuuuguuuguacuuauauuaacuugagagaaaguauuaggaaaaacagaguaauucuguagaaauauuccugaugauacacuaggcaaagcagggagaagagaaaaagugagcaagaaauugugacuaugaauuccaaaccaguuuggcuggaugagccaaaaagacaaaacaagagcauucaagagucugucaggaagugguggccuuuaguucauuuuaguagcaagaaaacugaucuuuuucugauuuuaagaacuauaccaucucuauucugggcuucacucuuagcucucacaguuagaaaacagugagccuuggucaagucucauaaacugugucucaguuuuuucauuuauacaauggccaaaaaaaaaaaaaagaaagaaaccacaaaaccauaccuucuuugcaggguuguguaaaggaagguugaacuagaauagguugaagucaaucacaucucuaaggcauuuggcauguaguggaaccucaguaaucaguaguuuuuauuauuuggugcacgaugaaacuggcuaucuggagauguuuuaaaauacagguuuuauuauuauuuagguaugcuaagaccagcagaucaggagacaaugaccacugaaaagacaguuugugagaguugugaugauugugaucuguguccuuuacaguuugcaagggaaggggacaugcuaugucagaguggagggacauggggaggcaccaggacuggucaagaggcagagggagagggucaaaccguggguucuguggggaggacugaacgaggcaggguaaguagacuaggguuugaguaaguucagcaggcucuggggaagaggggcugucccuauuuuucugguaccuggcccugggugauuagaaaggguggaugguggccuggggcaugagaaauaaaggagguggugggguguaaguucuggauugguuggguugcauucaaaaggggugcccccaagugaguuguuugcugccucuaggaauuuauugacccugggaggggagaucccagaugucaaagcaugggaggacagaaaagaaacagcaugguucccacaagagagaaguagacagagaccucuggaaguuuaaaaauauauauguugggauuucauagaugaggugagcaaaaaauuggccgggaagaacuauuaaggaggagaugaucagaaacauuuucaaaauaccuggaacaaacaaagaaccacauuucaagaaaaagacagagaaacaagacuagcaaauagaguuuucagguggaaaaaucacacguuggacaggagacugaagguaagggaaaccaagucaggcuuuaacaccauucugaauugcagcugcaggaucacuugcuuuagauggaaucacccagcggauggcguuuaacucugcuuuaaaccccuucauggcuucccaccacacuuacaaauacaacuccuuauccugucagcaggggcuugcuuaaucugacccuuuccacauaugcuggaucacuucacgccucccuguucuuucaauuccuugaacacaccaaguuccugcauucccgccucagggccuucaccuucagccucucuguccccaccugcuauccuccccagcuuugcacaccugauugcuuuuuguaagucagaucucagauuaauugucgccuuuacagacagauuuuucuuaacucuccagucuaaagaagccaccuccuccaguucucagcacugugcuucucacucucguuuauuuuguuguuuauucauuugcuugucaucuguauuuucccacuagaacucaaguuugugacaacaaggaccuaggucauuuucacugcuguagucccaguuccuacaacagugcccaggacacaccaggaacgugacauuuauugaauagaugaaagaacaguguaaaaaccacauugcucuucacucugccugcagccaacucaagaacaauuuccuaaagcagcucugaaaauuacgaaagaaauagugcauggauuccagccccaguaggcuucugggcuugguguuucuuuaauuucauguaaauuucucuaaguaaauaugccuuaaaagugaauaaaauuuuauuucgcuuuaacaagagaauauaaaaguuaaaaaggucacuguaguaauagacuaaucucaauuaccagggcagccucugaaacccucacucccaccuaaucucauucggugcauacgcagcucaccgugugauuuccaacacagcuaaaugaaauuauaaagcaguguuaaauuuauuaaucauuuaauuagcuaaauguuccugcaaguacuggcuagaugaauggcaugucauuuucuaaugcaauuugccucucaggcagccagggucagaaagggaagcuccuggcaucucgaaugagcucuuuauaucacaccuucuacugggagacgguuguuauaccacugauuauauuugagacuuguacacaagaccagggcacucagaugcuggaauuggaaaaugcucucuuucuuaccuggguuacaaagaggaggcucaggguagcugaugagucccccagagauugucucuccccguguccccuugcaggacaaaucuuuucauauuuaacaagccacugagcagaacagggggaaagauagcaggcaguauuaaacgcaugcucaaucuaguuuuauuucuucaaauuuacucagucgagaaaaauuuguggagugcgaauucuccucaugcuaggugacuuucuaauccuucuaguugagucaggauuuauuucuccauucucgccuucuagccugggcuugucagcuugggguguaugccgcaccuccucuuugaagaggaucuucauuuggaggggugaucugacucccaacccuccccaggugaaagcaccgggauucauaccuagggggcuuugggauuuggggcugacuuugacccgucauuauuucugacugcaaaauuccugacaaaugucugcugcugggugcucugugaaucuguucccauuugcagugagagugcuggcaucaagcacauugucuaaauucacucggcaagaagccguuggagugggugccacgugaggccgagaacauccaaaugaacacuggucuguuuguucaagaugggagcugucaguugugagagcuccuaugggaagaguguuuugauguauagacaucccugguccacagagccaccaagcaaggcagacuauuucgugagaaagaaggaagauagacuccaugcaacacaguggguguggcaccaagcgggagguggaggguugcuaccuagucccggcuccaccuacugucaccugcauuccccuagacaaaucacagcaccucaggauccuugaucucaucaucuguaaaacagagaucagaugaacccucgauauuaauaucaauaagagccgaucauaggacugcucuaaggauuaaauacaaugauguaaccuacuugaaagugucauauaaauucugaggugaaguggaggcauuauggaugcauuuuauuuuguuuuauuuuauuucauuuauucuuuuuuugaagagguaugggucaagcagaucugcagcccacacucggcucacugaucacgucccauacaaucuuggcagauacuuagcugaauuccaucgauuuagugauaaaaugggaacaguaguaauggugcagauuagagaaaaaaaugugauuugugcauucauaugucuguguguacauauauguauauguucuguguauauguagacauguauagaugcauguguguacguauacacgcacacauacauaaauuguguacauacacauauacauauacacauacaauacauauauucugauacacauauguacauauauguguauacaugcuauauauaauguagcacguuuccuggcaccuuguuugguucaauaauguugcugggauuauacuacaauuuccauuacucugacuauggcaacacugcugauauaggagaucacuuuuccgcacaaacaccucuagguauuguuuaacacagaccucaugaaauagguuugccauggauuagauaaggcaauucuggacucacuuccaggauagaaggcaaagacaaguaccaauauauuugguaaaaauaugacaugacauuugagugcacacaggcaagugaaggugguuucaaauccucccucugucuuuucccagcuaaaugaccuugugcuggcuccucaccuccuaagccucagcuuaucucuaggauggacgucauuguacucccuucaucccaccuaagguuguuguuaaggaugaaaugaaaaguccacagcauaagcuugacacauaaaauaagcacccgaugaauacugacuaaagagagaggaggaguaggggagagaaggagagaagagaggaaaugaaaauguuucugaauaaguuaugucuaaguuuuuucacuuuuuauuuuuuauuguuuucaggacagggucuuguuccauugcccaggcuggagugcaguggcgugaucuuggcucacuguagcugcugucucccggauucaagcgauuccccugccucagcuucccgaguagcugggauuacacccaccaccaugcccggcuaguuuuuguauuuuuaguagagaugggguuucaccauguuggccaggcuggucucaaacucgugaccucaagcaauccacccgccuuggccugccaaagugcugggauuacagacaugagccaccucacgugguugagauuuuuucacuuuaagaaaugcuuuuucugucaccucccuggacugucuuggauuuguuucuuugaggggaaauaugaggcuuuaauuuucccucccaggccuuggaaaggccaagagaagccuggagauaggaauccaccuacacagagugucucaguaaauuggcaguggccaggaccagaaccaggacaccugucucccagaucuguccuuuucuuggauagcuugaaguuacggguaguuauugaauuggucacuggcuacccccugaaucauuaccugauuuuuuacugaguguuccuaccugugaguaaagggugccugguuuugcacaaguguuuucuuggcccaagagauauuuuuauauuugccuuuggguugaugagaugcugguauguaucauucguucagccauucuuucaguaagucaucacggaagucugccucugugacagauucuggggcucuaaggcggaauuuacuucuucaaaguacaguuuccugccuugcaaguuuggaguuaaggccacgcagaccagaguuacgugcacagguuguaauacucucucuugucccugguugccugauucaaguuaggggcuucuucuggauuccguagguaggaugcugacucucagcuguccugaugccacugguguuccucuaguaggcaacauugaugguaaacauagaaagucauggaaggccucaguuaccucuagcccugaagacacagggauacccuuggggcggagaccuuagggacaggacaauaaagaucaggccuugggagaugcaaacaguuugcccuuggaccaugucuucugcuuucauccuuaugcucucaacagaucaugccaagguccuguguucaccgccuuccugaguccccauucagaggcucaagaauugagacaaaagggcauccugcaaauuugcugcccuggaagcugugcugggggagccaguagagacuucagguggaucuggagguccuuccccaaccuucugcaaaccaugucuucccagagagcuucuaagccaaagcaaagguguugcucucugccuccuguugcucuguaauucaucucagcaaccaucuuucccaucucugggaagagaauguugucccccagaaaaaguccuuauggauagauuuaguuauugcuuaugguuuagagaaagcgccuuucaacagucacaugcaaguauucuuucaggcauuuauccaaacacacaggaugaggccucuuugucaaaccaguguuuguugacaagcgacauuugugugcaggagauggcucauuguguguguuuacuuggagcuguuauauaugcugggggagacacuguguauacaaaccuaggagggagagauugggaggagggaagaaagugaggaauaggcuuagugagaaagagaccagagaaagagaaaagaaauaaacauuagcagggugguuaaacauccaagcauugaaaacugcgugguggagcuauguacuaacuggggggucuugaggaagcccauuagucucccugagccucaguuuaguagaaguaggaaucgucauuaaggcgccuaauuuaugaaguuacucugagcucuauaagagauaagcauacagaaaacuuuggacagugccuugcacacagucaguaaucaaugcauauucaucaugauguuagagaaaggccgggcaugguggcucacaccuguaaucccagcacuuugggaggccgaaggggguggaucaccugaagccaggaguucaagacuagccugcccaaaauggagaaacgccaucucuacuaaacauacaaaauuagccuggcauaguggugcaugccuguaaucccagccacuuuugaggcugaggcaggagaaucacuggaacugggaggcggagguugcagugagcugagaucgugccauugcacucuggccugggcaacgagcaaaacuccaccucaaaaaaaaaaaaaaaaaaaaaagagagagagaauaaggucagagggggaaaagagagaaagugaaagcaacaguaaggaagagaauuggaaaaaaaaaaaaaggaacugaucuggcuguaucugucgaguugcuucugccguuucuagcccagcccacgguuuucccucugcagggugucugugggcaugguuugcaaauaaacagugagaaguauaagcuaaacauagacuuuaggcauauacauaauaggcaggcgugaucgcguucacccauucaguuugccauauaaaagcuuuuccucggugccacuuuauggcccagaaacaaggcuacaaaaacuuuaauacugcuuuuuauuuuauagaaaaauauaaaucaauacuuucaugucuguuugacguguuugggagcuacagcaauugaggcuugccagugucuggaugccccaccacuaccacgccacuuagcucagaguuuguuuuuuuccuuccaccaugugaaauguugcugguuaaccaguuaaaacggggagauggccaugauugcuuuuagauugccacuuccacauugagugaauuuuauaauaagaagccauuuuuuccccgacaggcugcccuugugcccgccucucugacuuugagguccucauuauuguggguuuaaaugaaggauguucauucaggcagggauggggggauggggggaggccaccaggcaucagcgcuguuaucaggaccuucuaucaggccaagugacaggcguccagagcaagaaugcagagcucaugguggagaccuccggcugacaccaaaggugacuccccucacucuaaccuugaaagggaaaguucccacuuuauuaaaaugaauuucgaaagggccgcucugacagcugcauaauuaaauacuggagugucagcgauaauuuauuccacucgcaugugguggucagauccuuuucacuagagggucagcaaacucagugacagaggcaaggagacaagggauucagggcccuuugucauuuauguagcaccagcccugaaaucggagacucauaaaaccuacaaauacacacacaaacacaaaccaggcaaacccacacaccacagagaagaggcaaagugugcauaaagauacccuguuguuauucacccaguacaacucucuaauucauguauaaacaguaaguguaaaauguuccacacccuuauguauagacuuuuaaccucuauuugagggucucugggaggaccauaguuguuucugaaguaucacuuauccuacguuccauguaagaucucuuuccuaggguaaacuugauauggaaggucuucacagauuaaaacgaaggaaaaaaaaaaaaaaaacuagauaaaucucccuggacaugaacuuuuguagaaguaguuacaaugcuagugaccucauauacucaugguaacggcuuccggcauccaaugaccuugccauugcggaggucaauuucaugugugugugcacacaugggugcguauauguuacagagggaaacuugccuguuugaagcaggugucguggaaacaacaugggcuuuagagccagacauggaauccuuucuuaugauuaaugcagcuaaauuucccacugcagccgguagcauauugcuucauaaaugucuauaaaaaaauacgaaaaauagaaucagagcaaauucagcauagaccuccuugggauguuuauucuuuguuuauguugguguuuuguuuuguguuguuucagcuggggugcaguuguauucuguucccucuuugcuaguucagaggcagugaaagcgugcuucucaggacucauuguccagaagauucugccuacagcugguuuuacgcagagaaguagcacacaaacccaguccaugauuucuuauuugacucuguccuguuuacucugucagggugaaaagcacaggccaagcucggcuagucaaagcauuacuuugucacaggcaggcuuggcuucuccgagucagccugaacaaauuacaucccucacucggucgccgaaccgggaacaggguuauaacucagucuaagcacccgucccucuucuauuaccuucauaaccaaggucauacuaaucaacucaauuaccagcccucucagacauuuucauaauguuuucugguaguugcucuccugugaaaaucuuucggucuaagcaaauuaaugucauuuucauaacuaucugcauuucagguacagugaucuccuuuaaaaaggcugcgucccagcagcauagaccagcuuuaccucccagcguagucuucagacaaguugggguauugccgaaguccauucuugacuuuuuuuaauagugcaaacaaaucaucuuguuuuuaggaaaacaugaaauuauaaagaaauugacuucaaucacuucuggaggcagagcacugaguugccuccccaccucauuccccucacucccaacucagcaaccuggguguuucagccagggcuuuuccaggccuuaauuucucugacacaggaggauggaauuacauuauuuccaccacaaagauuguguuuuaaauccuucuuaguuugcagcuuuucuucccuuuugccuccucuuuaguucauuccaaugauaaauccucccuccuuugucacagagccacuguguacuuucauagaccauccuauuuuucaacgagaguucagaaccacaccauacgggcaguaguccgcauuuucaacauuuccuaacagcacaauuguuagguagcuaacaauugaauugacuaugucagguagacuuauuuuucgaguugugcugguuaacugcaauccaaguuuaggaagcaaacuaccaauuucauuuaauagaaugagcuaaccaaggcacauggugacuacugucccucaagaccgcugaacuaccacuuccagcaccugcucagauuauucauuacaaugaagcucuuuaacacuguguuugcauucuuuaguauauaucuuguuaauaguaggcccugaauaaagaccaguugaacaaauaaacuauuuuuccauguauuaauucuuuagugaacuugcuuauuuguucagaagagacauuaagcuaaguauacaacacucgguaaauuucaacuucaucauauauauaauaauuauuuuuuuuugagacagagccuugcugugucauccaggcuggagugcauggccugaucucuacucucugcaaccuccaccucccagguucaaacaauucucaugcgucagccuccugaguagcugugauuacaggugugugcuaccacggccggcuaauuuuuuuguauuuuauuagagacgggguuuugccauguuggccaagcugaucuggaacucaugugcucgagcaauccacccaccucggccucccaaaaugcugggauaacaggcaugaaccaccaugcccggccaucagaaauauuuuauuucacuauuuuaaaaaauuagcaaagaagcaaauaugacaaaaugcuaacaauuccaaaaugcuaauaacuucugaguggugaguauaagugugauuauuauauuauucuuaguauuugguuuuuuucuguaguguguaguuucccuccaugacacugagggcucagauggcucugaccuuggagacagggagacauuuagugaaggaaugggagguaaggagcuggcaucucugguguguccaucaugcacugaccugcacuagauguuuugcuuccagagucuccuggaaugcuccauggccuccacgcaucguaauucccaucagcuuaaggcagcgaagcgaaugcccacagugcccaagucacuugcccaagguuauccaagucaaauaagacagagaugagauucaaauucaggccacaaugacuucaaaaacccuuguauccuuguuuuguuucguuucccugcaaacauuguuuuaguugagaugaaauucacguaauauacaguuaaccauuuuaaaguguacacuucaguggcauuuagugaacucaguguuaugccaccgucaccucuuuuuaguuucaaaacuuugucaucaccccagaaaagcauacacauaaagucaucacugccccauucccuucuuccaacuucucugcuuuuggucucuguggauuugccuauucuggguauaccacauaaaaggaaucaaagaauaugugaccuuuugugucuagcuccguucacuuagcaugcuguuuccaaggcuugucuaaguuguggcaugugucaguacuuuauucuuuuuuauggcugcauaguauuccacugcauggauauaccacaucuuguuuaucuguucauccauugauggacauuuggguuguuuccgccuucuagguauaaugacuuguguugccauaaacauuuguauacaaguuucuguguggacauguucucacuuuucuuggguauauacuuagggguggaauugcugggucauaugaucagucuagguuuaacuuuuugaugaacugacaaacugcuauccacaguggcugccuguaccauuuuacagaaaaucucugcuuuuaauacuucuggauguguucuaaggcacuaggcuuuucauuaaguucauuucugcagaaagaguuaaggaguguucucagguaacuauaaucaacccccagggacuuacucaaguugugcaugugcaacugaaauaucuggcaggcauccagucccuguuauuucagucucuccccgccucccugcccacaccucugaagcuccauauuacccaggaagggacaauggggggccuagaaauguggagggaggcaagagagugauaauuaugccaucuacacuugucgacuagaauuuccagguacuuucaccucuaggcucuuaccuggcuuuugugaagccccucagggaagaggaggaaagcugggcaagggggagggguaaaccaagucccaggaaagucauuccaguuucccaagaucccggagcuuguuuguauccagcugagauccaguugagaccagaauucacucucuccacaccuccaucagcuguggccucgaguuccuuaacauuuuuuaaaacaaaaaacuuuugcaugggaaaaaucccuuuagaaaguuaaagguuuuccuuauacaaacuaucucacuuugaaaacuggcccacuguaaaaaucuugauuccggagcuuccuuaaaaaucuuuucaccccuuuaaagugaaaguuauggagaaucuauuagauacaaauuaauacgggcaaggcgugugcuagcuguuuuauaaacaugaucccacuuaauccuccacuucacaauucugaaaagucaacaaauuuggcccaugguagagaggaggaaaccaagacuugaaacauuaaauaacauguccaaagucucccauuucagagacaggggcauuuggcuccagguuuuucugacucuagacaguaguuuguuuuuagcacaucaaaugucugagacuugugauguguuagaaagcacaaaggacuuugaucacaagaucaagccccagagggccaugacugcauaaaccacaacaacugcguggcugccugucacgucuucaucugcaaguuggaggaacuuggagaaaugcagugcuucccugcagcugcagagggucucacugagcacuauucuuggaauucuuaaaagcugggccuguaagccuuuuuugcauuuccuuucagccaccuccuggcuguccuuuuaaagccaggguaaaguccccagcacccagaaucaaggauggggaagaggaauuuugagaaugugcuuccugcuucacacaaauagcuaaagacagaaaugauggcacaagcccuaaccaacaacuaggaagguagguuguccaagacaaauugcaguuuagaauggaccugccaaaugggugggugggcaggauggcugggaucgccagugcccaaccuugccacagccuccuuuugucacucuagggacuacccuuuuccuccccagacguuuuuccugacucuaaauagugggaaaagucugguuugagauugcuguauugcagggaaguucuuacagcgggcuugaugggcccagaaaucaagauggaaaaaaacaacccucuauguugauggccaugcacaguggcucagcagaacuggcucuguugaccaggcuugggugcucuccugcagggcauugcaaucuuuaggacaccuucauuaccccuccuaaaaggagauuuuauaaugagcgccaaccagcucaaacaaguuaggaucuccuaacaugucuggugaaaauacaggaguauuuuucaucaucucuggaaaaguugcuaucauguccuucaauaacccagucuaaccauguuuuuccaguggaaaugauucccgguagaauguccuauguuccuuuugcacauuucuccuuacaaacaucaucucauuuaauccucaccacaaaacugauagugucaucuccaauuuauaguugaggaaauagaggaucagagaagcuacgugaucuaugcaaggucccccagcuaggaaguagcaaagauggaauuugacccaggucugacuccagaagcacuuuccucuuuugccuccuaauacauuuucuuauagggagcauccugcaauacaacuguuaagaccacuuaauguuaucuuuggauuaaaaaugguaccacucucauaaaucaaugaguuucauacccuaaauuaugccagauuaagaaaaugaaaucugacuguaaauuacuucucuaggagcaaaugauugcuugauucuauuguagaaaauaaaaauuuuuuacuuaaaccacacaaauuaaaaaauggaacucacuuucacagucaagaguuacuucuauuuuuuuuuacaguaaaugcgcucuuuaagauguugcaagcucaauucaugauuuuuuuuucuuuuucuguauguuucuaaauuuagaaguuacauuuacaaggagguaauuugcaaggucauccuuuuuuaaagaaauuuaagcaggagaugaggucuuuccagguuugagggugauagcucgugauucuucaucaacuuuggccaaaccuucguggauuccugugugcugauuauuagugccuugccuacaaauuuuuaauacauugacuuaucuaaauauuccugcaugcacacuccccaaucuaagaaaaaugugagauguugggaaauguuuccaagaauagaccaaaggauuagucagccuagagaagugaacuuuaagaggaacuauguuuauucaguggugauuauuugcugacccagugcuaggcacgugagagugagagggauggaaugcuugcaggaguugccuuggauaucacacacugacuugggagacacacauagcgacagauaauuacaacauagggacacccggggaaaauguagacgagguuuagggguugcucagaggaggaauuaacucuauaaggaaguauucugauaauggcuuucaauuauaggacauaucuaauaacaugauuacauacucucuuaauaguguagcacuauaguuguuauuuauuucccacacugaacaaauauaauuaucauauacacccuuuccauuauuagcucucuccauuuuuaaugaaaacagugguuggugguuuauaagaaguuuuuugucggugucaucuuucacaucaguuugcuacccagaauuuaaacauuccuuuuuugcugcuguuuuaauuugaaauaagaaugguagcccccagguccccuaacagugggugcugauuucacagugggcuuacaaaugcucuucaagaguaucucaguguugaguccagccacccaagggagacugguucuucacugugcaucauggccuuuuaaugccauuuugcuuuuuuaucauccaaucagcagauguucuuucuucauucacguugaaagcacuucgcuauggaaacgaguaaaguucauugucuuauuuuuuguuuguuuuguuuucugauguccugacagcagaaucaaucuucggaauccuuuucaauaaaaaaaaaaauuaccaaaacaaauaugaucacagaagcuuuuaaaaucugaaaucccaggaagcuaauuagugcauccuuuuaagauggcuuccugcauuucgauauacgcauaagcuuggguuucagaugcaguuggcaguuugccaugagucagacaggucauccugacucucaggaacacggagcuccugcagaagccuguggagcgagggcaaguugggauccuccccuguguuagcacgugacuguccucugucaccauguagcagguggaggccaggaacuacauuuucuuggguuccuggugguuaguuguacgccccaugaacuucucucauuuccuuaauuauauccaaaauaaugcccuuguuuuauuuccccacuuggcacugagccuuagggagcaggaacuguguauaucccacagcuuugcauggcacuuggcacguaggaauguauuaaaugcagcugcuuucgugcaggaagcgcggacuucagauuuggucaaagauccaugauuucagagcaggcagcccuuuuaaaccuguaucugagucacuucaaugccuuguguuucugcucugggcugcaaacucaagagcagcaaccacuuaucuugguaccuguagucccgagcccugugucuggcucagaguaggcccuacauaaauguuugcuccuccucacugaguggcugcaugaauugcauccagcaugucuacucugggaaagaaccuguggagccucuuuaggaguguguuuuugcccucccucggaaucuggugaucucacuaccaauggcaaagacaaacugugagguguuuuuuuguuugugugcacgcgcacguauguguguguguaaaaaggccauggaaauauaaaauuguaaccuaaaugccuucacggccaguuaugguggcucacgccuguaauuccagcacucugggaggccaagaugagaggaucacuugagccuagaaguuugagaccagucagggcaauauagacuaccugcaaaaagaaaaaaaaaaaaaugccagguguaguggugugcgccuguagucccagcuacucagggggcugaggcaggaagauugcuugagccugggacgucaaggcugcagugaaccaugauggugccacugcacuccaggcugugugacagagcaagaccccaucucuaaauaaguaaauaaaugccucugugaauccauuucauugcauuggaaagaccuccaggauucucugcagaagaaucuuucccaacauaaaauccauuguuaaucacauuugacacacaugugugcccaugucucugggccuguguccauaggcaucuacgucacugcagagugaacccuuucgguucacaucaccugcuccccuccugggccuccugaggggugugagaguggcacauuccacaggaagggaacccugcauguccaugugccaugugccaugugccaucuuagagacguaaaaacacuuuguauguuugggguacaacucaguaacccauuggugcagauaugugauucuuaggauggcccacaugggucucuuucacacacccacgugcaugacccaagugagcaaacaggcagagacugggaccagaagcucacugugguucuaagcaagcaguugaacugguggcuucugauggccugagaagcaguuucccuugauaagucuucagccacacaaaaagagacuguagcucacaacacucacagucaaagccacuggaaauaacuauuuccuaucaaauaaagccuuucucuugaaaaauuugaagaaaaaaaaaaaacccaccuagugaaaccuuagaaucaaccugaagguucaacagcaggugaaugauuccauaaaucauaguauauucacuuaauggaauacuagguagccacuaaaauaaaaugacaguuggaaaaaauacuuaugauaaaagguuuaaugacaaagugggguucaaaaugagagauacucucugacuagaacuauauuaaaagaaagauggaugggggagaggacggugggugauauauuaucuacauagauacuuuuuuucacuuuucaaaguguuuaauguguugcacagccuuuagaauuugaaaaugucuaacuuaaaaugccucccuagugaaaucuguggcagcuuauaaacuggcaggauacuguauuuucaagauacgcaauuguaaguggugcucacauacagucagaauguuuauuugaccuugaucuugugagggcuugguucccauggcuuuguagagugaaagguccugagaggcagguuagugacgauaccgggacacguauuguagacagguugauaaagcaagcuucccucagcccaguuuucaguggcaaaugccucuuggccaccaaugcuguacacuuuguuucuguuuccuuaccugucaggcaguuacugaaaaauuaucuuuucccccaaauacaauaauuagugccuuggccagacaaguuacagcaaauccuucaagauuaagaagggacuagccgggugugguggcucacgccuguaaucccagcucuuugggaggcugaggcagguggaucaccugaggucaggaguuugagauuagcuugaccaacauagugaaaccccgucucuacuaaaaauacaaaaauuagccaggcgugguggcgcaugccuauaaucccagcuacucugggccugaggcaggaaaaucacuugaaccugggagacagagguuucagugagccgagaucgcaccauugcacuccagccugggcaacaagagugaaacuccaucucaaaaacaaaaauuaagagggacugauguccagugaauuucuauguccgcccuaagcacugaggugaaaugaagccuagaugguucuuuuagaauaugagugagcaguacucaugguuaauuuuagaagcuaauaaguauauauuugauaacuuuaacagaaauauuaauacuaauuaagaguaaaaagaugaugaauaaaguagcuucacuuauugagccuuuacuagaugccaucuugcauaaaugguugucauuuugcaaaauguauuccaucuaauauuagcaguaacccugaggacuugguauucuuaccuggaugugucuuauaucaacaugcacgcguucucucccucagcauaccgugucuuauuaacuucuaaccucccucucauuaucccaccaaucucugccaguacaaccacaucaacugugcagaucacuucucuaguguuugggauuuggggcaaccuacugggucuagcuaugaccccauaaaaguugaacaacucugccuuaauggcgcuaauuuuuaauaugccucauucuaguugcuugaauugaacgaaggcauuugaaaauugcugaagugcuucucagugaugaaauguuacagaucaguuugaaauccaacuuuauucaacauaagaaagccuauauacucuggagcuuaaagacugaccuuuucacuuacuguaagguaucuaagacuucuggguguggguuuuaaauauauuuuggaugagcuuuguucauguuuacacauggccaccaggucggccacaaagcuguggcucuggucagucugacucucuuuagcaggaaucacgugacaaucugugucugugauuagcuccguggauauuacuagguagauuucucacuuguccuuguuuugaucuucauuccugggugaaagaaucccagggaguggaaaauguagguaguucauagggcuccugaccuuccauggacugugucuaacucagcugugaugaggacgugcucugauucugaugaaggauguuagcauuagaggcaggccugugugccuguucuguguccuggcaccgauguuuaacaaaaaagauccuuucagaguuacucauacgacuuacacauucccaugggagcuccaacucuguuuggucccaaugugcccuuuuugucucacuccuuccucccacacauccugcuccccacuccccuaauuacucaugauugcacuaacagccacauccuuucacaccucugagcuuuuggucaugcuguaaucucuaccugaguuccauuccugccuccacccuugccugucaaauuccuuagcuucaugccuuugaauuuuagcagaaauguuaccugcucuaugaaacuggauuuucccuuugucuccauucccuaagcugcacauuagagcagcuguuacaguuugaagugaccccuauauggauuguuugcacaccuguguugcaaauguauuaguuaggauaggcugagcuacaguaagaaauagcccccaaaaugcauuauagcugaaacccccaaagggggauuucuaacacagaaagcaacauaaguggguaguccuggccaauggcagcuacguuccacaaagugacucagggauccaggcugcagccacuuagugguuccauucucccugcugauaucugcauccagucaucugguauuucuuaccagccuuaaccucauucuauugguaagcacuagucacauggcuaucucccacugaaaaguaggaugucaaauauccucuagcccuuugcucaggaagaagagcaaauggauuuuuguuaagaagcuggcagucugucacaggagcuacuugaggauacacacaguuuucuccccauuagcaucugcagucucugguauaaacuugagucuucucuuuggucccugauaaauauacauagaauguauggaugugagaaaguuaaacugaugucugugugucuucaugucauuaaacuuugaaucuauggacaugucuuuuucuuucuggcauaguuuggaggucuucauuuuaugauagaauacaaaacaccgagggcuuuaaggaggcauagugguauguucagcuguauuuucucauaauauagagucauaggaaaccugagccuuggcauuuguaaggcaaaaagaccccuggaaaagaguaauauaguaauucaucuuuauuugaaaaguauaucaucauccauuuauuuccccacuggcauaauccaggccgacuuuggcuccccuuccugugaaaugcacccuuucccucucaucaguuuccaccccuccugcugaaaauggaguacaaugaauagauguauaauaaaaucuuuuaauugucuuagcauauguugcuuuuauuaggugggcauaauugcauucaugggaucaccuacaaaguccuuucgaauauaaaauugaaauggcuucacacucagugcacaaguccuucugaggcacuguuuuccccuucgcugccuccgguuccccuuuugcugugaaguucacauugaagugugaaaagagagacguggcaacugacacaugcuggaucuuaucagccgcgagugccguuguggccgacugaaaagcgacugucauuucuacaccauuuauuccucgccuggccucauugcucgcuucguuucggaggaaauuuucccuguuaaaguacuguacuugucauuuauuucccuuuuuuccacucucccuccguggcuggguuuggauaugcauuuauccaaaaggcaaggcuuuuacacacuuccgcuaaccucuuauggucaggcucauaaaagcaacccaacaaagcuuuuauggggucauuacagaucccucaaaucccucuccuuccagcuuucaauaauucucuugucucuaaucaauucaccggcucuuuuauuugaaaaugggugauggagugggggaaaaaagugggagcaucagcugaaaacccacuuuauuuggacuaagguuucucaauguguguucaguucuggcucaugcuuggcacuuacauuugagccauauucaguagucccagccuuacuuauucuuuuacaaaaagggucagcagacuuucugaaaagggacagauaguaaauauuuuaggcuuuguggaccauagggccugugucaaaaguacuaaauguuaccauuuuccuuacuuuguucaggcugcuauaacagauaccauaaacuagguagcuuauaaauaacagaaauguaauucuuaaaguucuggagccugggaaguccaagagcaaagcaacggcagauucagcuucuguugagggcucguucccuggcucauagaugaugacuucuugcugugucaacuuagugggaggggauaaagcagcucucuggggcuucuuuuagaaaggcacaaauccacucuugugaucuaaucaccuuucaaaggcccuaucuucuaauauuaucacauuggagauuccuuuucaacgcuugaauuuuuugaggaugcaaaccuucagaccauagcacuaucauagugcaaaacaaccauggacaauacacaaaugaacaagugacuauuugcuaauaguuuuauuuacaaaaaacaaaaaacagugggcaggauuugacccaugggcugcaguuugcugaucccuguuuuauuaauuaguuaauauuauugauugagauagggucucacugugucacccaggcuggagugcaguggugcggucacagcucacuacagcuucaaccuccugggaucaagcagucuucuugccuuagccacccgaguagcuggaugacaggugagcaccaccaugccuggcuaauuuucuaaauuuuuuguagagacaaggucucacuguguuguccaggcuggucucaaacuccugagcucaagugauccucccgccucgaccucucaaagugcuagaauuacaguugagagccaccacacccagccugauuccuguuuuacauauuaaaaauuucaucucuccaaucuucgaagaauccguaguccauuuuuaaguagcucuugucuuccaaagguaugggaugugccuaccuaaugcucuuccuggaugggagaauauuaccaaaaacguuuggucgacuaauuuuaugacaguuuccaacuacaauuuuuuuccucuuugcuuucuuuugaauaauagaaacaauuuuuuuuguuuaauauaucuugaaguacuucacuuaagaaauaacuucaugguggcacagagagcuguuuaguuagaagacugaguauuauauuucccauugacuaugcaggaccuucuagggaaaugugaguuuaucauacuccugcaagguaaaugcagcagugagaagaaucagucuacugugcuaaaccuggcccugccucagcaauauucugugagccuggaggucaagaguuaggggaccaagguccugcuaaggacacaugggggaacuaccagaaacucaucaucucauuuaaacucacaaaaccuggaagggacauaauuaaaaguccugucuuccaaaaguguagcauuaaacucagagauguaaaacaacgugucuaaaugccagguaagcaaugcuuacuugacuuggaccaggguggugaaugaacauaaaaaccgauuacaacauuuuuccauuuuuauguuuccucugaaaccagccaugagagguacucuuagcaaaucacgccuuauuccuaggcagacuucuuggguacacuuuccacccuccccagcaguaaugccugaccaacuaauggaauccuaacuaaugcaguaugugacgccuggcagcuccaguccgaaccaagggaaaaccugcaaacaugcaauccuucaugcuuuuguuuuuguuuuuccuucagccuagcuaaaaugaaggcaacauucagaaugauguuagaaucuagguguggaaagcaauguagcuucuggcugguuccuugagugaccauguggagcagagcuucccuuccauuguauuugagccacuggaaaucuauuaccugaucuuucuuuaccagauccuucuuuaguuggguauggccaggcucagugaauccaguagauguuugaaugggaaaggacugaaagaucucaaccuugaaucccuuaacuccuugggauguguaauggagauguauaagcuguuuuuaaacauuucagcagcugucauggaacuuaaccaaaugagucuaaguacccuaugaacacauuugauuuagguuggaauuacagcauagaugugaagugacuuguccaaggacacacaggugaugaaguuuacauacaagacuuaaguccauguuacuggauuccuagaccagguuuuuuuuuuccccuuaucccauagaagaugguuguugucuugagguuuccacugaguugcuuuuugagagauucuauugugcacuuuugcccaguucaacaagaaagaaucuuugcuauguuagaagagacucuggggaauccagagucuuggucacggguacaucaaaacgacgcuggugccuaacuucuaguuccagacaaagaaggagagagagagagaucaguaauuuauaggcugacauuuuccuuggguccuuauaauacuuguuuauuacagauaauuugcuuaagugugcacaagguggaaggucacgcaaggaagcuuuuuauuaguuguguacugaauggaucaauagugauuugaauacuauaaaucuauccguuaacagguuuauuucuucaucagauauuaauuccagaggguuucacccauuauaaaauggacauaaagccugggguggugauggugcugccucuguaaccaggcucagcugugugucuucgugagccuccuuguggacccucaaaugugggaaggagauaggggcaggaggaauuggggaaauaggaaccuuagaaacccugaagaaguggaaagagaaaaggaaggucagucauucauucaauugcuuaauuugcuucuuucuuuuucucuucuucuuucucucucuucucucucucuuucucccucccucccuccauuucuucauuccuuucuugucucccugucuaucugucuguguauaucuauucaucuauccauccauccauccauucaucaauccauuuauccacucugaauagaaaccuaauauagauauacaaaaugaaaaacuaggaaaaugcaagaaaccuugacaaaauugcuacuguuucuaauuccaauacuuaauaauaaccacugcuacauacaaggacauuugugucuggucuuuuucccuauuccaggcacaugcauuuuaauacaguugagaucauauuguaugucugauuuuuuagcguauuagauuuuuuacauuauuaaguuaauacaugcucauuuaaauaagucaaacaauaugaauauauaagaagaaaacgcucguaauuuaugcucuaccucuucccuuugcuaaguggcaauuuuggaccuucugugaccgugcaaacaugcagauuauacaugcacuauaggaguggaauguaugugacuuaauagcguaauauuuuguccauuauuuuaaaacuugcuuuauuuggucaagacauacggaacacguauagaucaaacaaaaauuuuuaaaaaugcuugcauacugcucugugcuguggaguagcccuaauuaaaucaaucauuccucuguuuaugggcauuccauuucuuuucaauuuugauauuauuguuguuuuagcccuuaugaauacuacagcaauauauguuauuauauacugcugguuuuaauuuuguaggacagaugggauuucugagucaaaggucaggugacauaauuuuguauccugugguuuuacuuaacacuaugcagaacgauuuccucguauuguugaaaacucuugguagggguuuuuuuuuuaauuggcuggaagcacuucaucauauaguuguaccaaaguuugcuuaacaucccccuuauuacucagccuuugggugguauccaguucuuugcuuugauaaauaaugcugagaugaacaucuuucugcauggcucuuuuuccuucuuuugacauacuuggaguucuagaaguggaauuacugggucggaggucacaaauggagaggucuuuuaaaucucagccugcaaacaaucccacugcagguuuaggcugcauguuucauccauuugcagcuguagcauuuuacaaaccacagcauaaacccuaggaauaauucuguuccccacugggauagagcauuguuauuaauauaauuuuacaaacaucauucguuugaaagcuuuauccagccucaccacagcucauuagugaaccuucugacaaucccggggcaguuuguggauucugcagcagacagguuaucgugugcugaaggguaccgcaggggaaccuuccaacauccccacccuacccaaaggaugauuccugcucacaccagccagcuggagacauuagagcauuacuucucgguggcaagggagggacucuuguucuuucuggugguucguuuucaucuucaggucaugcccugugucaccugacucaggcaccauuagcaucuggggcuguacacgucuuuguacugcacacuguaggguauccaggauuccuggcccugccccaugauauaccagcgccauguugucaucaaaacgaccggaaaugccuuuugugucucccuacuucccuuuuuaacaugucagcccuuggucucgauauucacaucuauauuuuuccuuaucccguuaauauauguuaucuaaauaugugccaucuuuguuuaugggcuuuugguguaagaacucucugagaaugcagugauucuucacugggauuggaagggaucagaaggagggaaaguaauuagcggggccuguuauaaugggguuggugggguuauuugugcuuuuaaaguagaauaucaggguguuuaaaagccaagauucuggagucagaaggccuggguucaaauccugaccccuccucuugcaagcuugugacaccgggcaaguuauuaaccucuuuaugccuuuauuuuacuauaaauaugggauaauuauaguuuuuacugcauaguuuuguuaugaggaguaaaugagucacuauuucugagacacuucgugccuggcacagaacgagcacuguguguguguuacagaaauauauguggguggguguguuucuguuuuccguaauuccagcuaggcaaagacauauuuaacaaaagccuucugggcugaugagcauccucagaaaguaggcugagggagcucuuuuaaggcagcaggacuaagaagguaaagacauguacuaggcgggucagcauagugguggcccucgucugacacacauauuucaggaggggucaccccugccgucuuccauguuggggugcucuucucuggcaacccacuauggguacuccacugcuggccuucaugcagguggaaccacaccgggaagacccaagccgaggggagaaggcgugagcagagcagguggcaggcaccaugaggcagggcuagccuugcccacugucuguggcugaccagcuagacucuuuuccuuuucuugcaaaccuaauguagguacaaggucaaggcucccugugaggcuugcauagcaccuucaaccuucuagucuuuguccucccagaaggaaaaaaaugagaggagggagggacacaagaaaagaagaugcauuuugucagccaccgugcuaugaaaugcuagcgcagaugacguucagaacugcccugugagcagacauaaaagcuuaggcucaaagagauuaaaugucuuauuucugcuuuuggaagauacacauuuuauuuuuuucugugucucugaauuggcauccaaccauaaucauugugcuaauuuacuguauucuuacucucccucuccagugcugugaguaaaucaguguguuccuuauacuuaauaacauacuaaguggcaauaauaauuauuauaacaaauguaucaaauaacuaugugugaacucugcauguuucagcccauuuaauacccauuaccuacggaggugguuucuacuauugcacccacucuacagaugagaaaauggaggcacaaaaaguuaaaucaucugcccuaggucccagagcuggaauuugaaccaaagguucugugccucccaaauuuguauucuuaucucugcaucacacuaacacugucacucaguccuuuucucacugcucuggucucuauacuuagagcuucgagaccugccacucagaugacuccagaagaaaacacgcuuuggugucgugcuugccuuugcccuugucacuuucucaacucuccucaccucugugacugcaucuuuauaacucuccuuuauuagugcuuuugcuggaggaggcaagcaugaacauugucaaaaggacucaaaauggggaaaaguggcagcaauugccagcacaaucacugaaaaaucuucugaauggauuguaaauuaaacccucccccaaaugcucagaacuguugaauugacuaauucaaauucauugagucagaugcaguuaguguaacagucuauaguaacaguguagacuauuaguuuguagaguccacacagaagaguccaauuuucuuugcacaaagagccuaccauucauuuauucaacaaaugcuuuugaacacccaucacugugacagacaguggcaaugcauguaggaacaaaguguguccaugggggcagagaccuggaauaaucagucaccauguaaggaaauucaccagaccaccaauuuccacgccuuguauguuucuguugucuuugcugcagacugaccaaaagcacaagacaaacucuuguccacuuggauuuuagcaucuuucccugacccugccucugacucugguguugugcacccacucugcaacucuccaagcuccagcccuguagugccagccuguaccugccucuccugagggucaauauggcauccagccuuggugaagucucccaccccguggugauucauaucugacccugagaauuuuccaccuuucccagaagagugggagucuaggaagacaaauagccaagauaggaguuugaagaggaggcaccaauggcaauuuggguuguuaauuccuccagcuaauuuaguucugauuuccccaugcucuuggcagugagacaguuggcuccagaggaaggugauaaaaaggaaucagucaaggaacaaucaagaacguguuacuuuuuuggauaaucauuggcuguagggauucuccuuuacauuuuaaagagggaugagguugagucugucccuagcacugacaaugaaacauuuaugcuguuuauaaaaaucaggaaacacacaaauaauuugauuaacgcucaccuucugguccuuuugugauuugagaggucuugagauaagaaaaacuguggaugaauuuuacugaacuauugaauugagaauggcugagggggagaggccccuucccucugugaaauauagggaaaaguuguuuuucuuuucuccuaguuucagaauacuuggacuuacagucccaaauagcaucauuuccuggugaagcccccugaaccagacaggaaacugccucucuucaauaagagcagaggcagucucaauaaaaaacaaaauuucaacccauccuccgcuuugguggcaggcaguucaucuucucaccucuacuuauuuacaguuugaggggaaaaaagagguaauacuugaaaguguauuugaccauauuuucuaacugggagacaauuuuuuucuuuaacaauuacuuuuggacauauuacuuguuaguuaaaggagaugugacaccuccugcccccuggccagccaagauccauuugucauccagguagccucagaacggauugagagcucgccgcacagaucucaugucaaagacaggcgcgucugucuuucacggcuuggguugucaggaugcagggagggccuuuugucaaacaccugccgaugagcguuuggcagagccugugcuaagacaucauagauuuccuucuguguugucuugagagcagagaagguggcagguuaaagggaaucaggaaagaaaugagagugaggauaaacgagagggugugguucucaggguagaaugcaucggacacugccuagugugagaagggacucaucuguuuucuaggaaguacuauaaaaaagauaaauuuagugcucagauaucugaggccugauauuaggaaaaauacgguaaggcauacauuuagaacagaugccaugucugugugugugugugugugcaugcguguguguguguguguauuauuaauaugucugcuggccuugagaagguacauucagagaauuuucugaagucuuuuucacauggccuguauugucaaaaaaugauguuggguguuuucugccuguggcugugggccucuguguucacacagauggucauauguuccuaaaggauacauccaggacugugcugacuuauuugggguggcugagaagagacaugagccagaugauaacaggaauaauucagugugugcuucccauggcugcuguaacaaacugcacagccuagagggcuucaaacaacaggaauauuaucucacaguccuagaagccagacgucugagaccacaguguggacagggccaugcuccuucucuagagaacucuccuugcuccucucgcuuccggugguucaguggcaacgcuugguguuuccuggcuugcagcugcaacuaucugaccucugcgucuguccucccacggccuucucccuguguguuucuggaucucuucuccuuuguuaucaggacacuggucacauuggauuaagggccuacccuauuccagucugacugcaucuuaacuguuuaacucuguauuccaaucuaauuacaugucuauuuccaaguaacgucacauucugaggcaauggcgguugggacuugaacauauauucuucgggacaugauucaaccuauaacaaguaauacuaguaaucaucucacuccuguaaacaguacaguugccauaccucaaguaucuaguauacuugggacauuagucugggaauuuuucuccaauccucacgcuagcauuucuaguaaugaggaaacugggggucagggaagcuuaguccacauuucucaccuuuucuccuuuucucccaucccccagccaguuuuucaacauauugguuuuucaccacaugcucacugcagugaauguucacucccaagcccaaaaguagacauguggagugacaggugucacuauaucauaauaugaagaauuucaaaagccagaagugcuugagaaaauauaaauugugcaguaaaagaaaacacccuaaaugugcagagcaggaaguagaaugacucuuuggguauuguguuuguuaggggggucauuagaaaaucauagacacugagccgaacccccuggguucaaaucccagcuccaccacuuacgaauugaaugacuuugagaaaguuacuuaaaugcugcguacuucauuuuccuccccuguaaaacggguuaauaucagcacuuaucacauaguuuuugagaaagcuaaacgugcuuaucuauagugguuauuauuacuagaaagaauaucguggugcccccaaacauggauuuaacaagcauugaucaaauaccuccuaugccccuacgaaccagguacuagaaauccacuccuuucacuugcuuuuguucuguuguguuuuugagacagaguaucgcucugucacccaggcuggagugcagcggcgugaucucugcugacugcauucuccauuucccagguucaagcgauucuccugccucagccucccaaguagcugggacuacaggccccuccacaccgcacaccgccaccacgcccagcugauuuuuaguggagacaggguuucaccauguuggccaggcuggucuugaacuccugaccucaagugaucggccugccucagccucccacagugaugggauuacaggcaugcgccaccaugccuggcuaauuuuuguauuuuuaguagagaugggguuucacuauguuggccaggcuggucucgaacuccugggcucaagcaaugcacuggccuuggccucccacauugcugggauuacaggcgugagccaccaugccuggcccccuuucacuuguauuuuuugagaagagaaagaaagaauuaugaaugaauucuucugagcugugaguccuuccugugcaccaggcauggauggcaaggcacgauugauaauguucccucuuaucucgaaauguccacucucucucccaugcacggggagucaagcugugcucuucaaacacaaauuccuucucccacuuccuggguaguuaugcucuuuucuucccugagguugcuaauugugggcaguacaguguagagucacuuugauuuuucucaucuccuuccuggaaugugccacagaagaaaacccacgaagucuugagcuaaacgaagcagagaugggagaagggacaaggugggaggcgguaguggugcugcaugggauaaaaauggaaacacacacuuuugcccucuguacccaaaaggaaaugucgguggaggcaggcguucaagcuggccucguguuugugguuuuagacacagcuuugagucgugaccgguguggccaagaccuauuucccuugcaaaugcucucucucuuuuuucgguaacuguguuacuaaaguucucuuagauacuuuacauuuccuuucacggauuuccaaaauuucuuucuuugagaaugucaggaccaguaggagguucagcacgcauugccagagaaaucacagaugacuaauuggaaugccucagaaucauucuccuuuuguuucaccuaauuuccacacuuacgaagucaaacucucaguuaaauguuuaucuagcaauucauuucuucugagccaucuguugcuaggcaggaucugcagaccucuugguugcaugugcuggguuggguccuccaagucucuuagcacaaaguccugauguuuaaauccugcaagcgaauugccaccuuuauuuccaaguucuccucgaaauccacauucuucccuacagacaacggugggguucaguguuugcuuuuccuggggcugcucgguucucucaccuugcauuucuguggcgccaagguaagcugaaggcauuaguauucacacuugugugugagcagcugagcuaacaugcaccagagggaaaauauuacuucucauaaaugcucaauaauuauagucuuuauugcaugcaaaucuauauugugacacauaguggaaagcuuuuggauucuguguggaagaguugacagagauuugcaggugaaaaagaaaagaaaaaaaauacagauacguguauauauagagaaagacaaaaacuugucugcuagaaaccuagggagagagaugguauugccccugggacauuggacuuucuguuuccagcauggucugucgucuuccauaauggcauuuaauuuuggaaaaauugccugagcauuuggaacaggcaucuauuaggaaagccuauuucuuuuuuuuuucuuuuuguuuuuucugagacaggaucucacuuugucacccaggcuggaguacagugucaccauuguggcucacugcagccucgacuucccaggcuuaggugauccuccugucucagccucccgaguagcugggacuacaggcaugcaccaccacucccagcuuuguguguguguguguguguguguguguguguguguguguguguguguguguguguuuuguagagacagggucucacuguguuggccaggccggucucaaacuccuagcuucaagcgauccuccuaccuuggccucucaaagugcuaggauuaccugcaugagccacugugcccagccuaggaaagcauauuuuugaggaauaauuauuucuaguaauuucuguucuaaucuaagggguuugagguuaucuuuugacaauagauguuagcuaggagagauaagaaauggagcaagggagggguuucaucccgccguguucauuugcuuggcuguccugaaauugcgaauacacaguuguuaccugcucccggugggaggggggggauauuuauuuggcaucuugcaauugauaggagcugagugauuuuaguagguaguuuaacuccuuaaaaacuuccagugguuucauauucuaccuaguuuuaggugacagcugguaugggguggggaaggggggggggauaaagauauuaauuuggaagcauuugauugcuccauuauuuuaucaucuucccauggaaauguuuucauaacgccuuguuuuuuaauuauuauuauuauuuuuugagacagagucucacugagucgcccagggcggcggugugaucucggcucacugcaaccucagucucccagguuaaagcaauucuucugccucagccucccgaguagcugggauuuuaggugugcaacaccacgccuggcuaacuuuuguauuuuuaguaaagacaggguuucaccguguuggccaggcuggucucgaacuccugaccucaagugaucugccugccucagccucucacagugcugggauuacaggcgugagccaccgugcccggccucauauccuuuuuuauggaaaaaaaaaaucgggaauuagcguguagcuauuaggcguagauuccugccuaaggucuggauaugaauuccaaagaccacuggacuuuggaauauucguaggucucugaaaauucagacccacagaggccuuaccccgcuacagagaggccccaagagagaggccucacacccucuggcuccacugaaauucacuucacguuuccaacuuggauuaaacuggcacgacaguucagucaaaugucaaguccauuuugucaagggagggaacucauucagaagaugaacuaguugguguuacuuagaugauuaacuacuuggcauuagguagaagagggcucugccaacuacaguucauggaccaaauccugccugcuguuuguuuuuguaaauaaaguuuuauuggaacacagccaggugcauuuguuuaccuauugucuauggcugcuuuugcacuacaguagcaaaguugaguacuuauaaauguagagccugcaaagucuaaaauauuuacuaucugcccuuuugcagguaaauuugaggacucuugaguuagacagcuaauuaguugguguuaccuaaauuuugugaauuguggcuaaaucucucauuugucuacacauucaaauaaaaucauguaucaaaggugauguguguauaauaagaugcugggaagaugagcaaagcaugacuucuuuuuuuuguuguuuguuuguuuuuaagagacggggucucgcucuguugcagugucgcccaggcuggagugcaguggcacaaccuuggcucagugcagccuccgccucucggguucaagcgauucuucugccucagcuucccgaguagcugggacuacaggcaccugccaccacaccuggcuaauuuuuuuuguauuuuagcagagacaggguuucaccguguugcccaggcuggucucgaacuccugagcucaggcaaucugcccgccucugccucccaaagugcugggaucacaggcgugagccagcgcgcccagcccaugacuucucuuuaugggagagaaaggccaccgagauaguaaguggacaucaggacauggauucuauuaaaucuaacaccuuuaucuuugcauuuccauacauuuugcuuauuucaaaguagcuacaacugcacaaagaaugggcuguccucuccugcuacuuuauaaaagccaaguuuuugcuucuagcuggucgaagguccugugggagcucacguuuuucucaauuacugaugaucauuugagacauaauuuggagaagguuucuaucaaauccuagcuggacugcagugaaauguuuucaaacuagagaagcaccaaauaggccaugauaaagaauaaauaccaccuaccccaaccuggcaaaugugugcucacccaaaaguaguggagccucaagcucagggagaugugacuggaaaauccacugaauaaaugucuauuuaaaaaaaucauagcgucuaggggauauacacuucuaagcccauucuucaauggagaauuacuuaugcgcauaaguaguuuaaacaaaauuaguggaaaaacagggaguuuaagggagcaagagaucaggucuucugggcucaccacacaucaggugauuuaagcuaaaaauggcuuaaaauaccgcaaucacuugaaacgccuuacauaaacugaccaggaaucuggggcauucgcguuagagacaauuuucuucuccucaagauaagggauggggaauuagucauaggguauuuccagauaauguaguuaacaccucguguaauauuaggugggcagggagcucugcucucaggaccaaaauugcuccugccagcucuaauagggaauguguguauuuuuaaagucuggguaagcacugugagucauuuccacaauacgccucccuuuggcgugaaauggggcagaaagugccccaaacagcuguuauuuucgcagugauucauucauucauucauucauucauucauucauucauccacccauccauucauucauucacucaucacauggcaacucaucaccccuguauaccagacccagugccaaauacuggggagaugugugugaacaaaaucucauuuucaaggagcuuauugccugcugcacauuuuagccucaucucguuagugcaagaaauaauuuaacaacugaaaaagaugugagguuguaccugguaaggucucuauuggucaaggaaagguuuagcauggagagauuucucuuaaggugccuagguauucagaagcaccccuaaaacugauuuguguggcccuaugcuuacaaguggagccuuucccucauuuuugcuuuauuucuuuugccucucacuuuuuauuuccuuuguggaguccagccccuuugcuuauucucagcacaaaagaggcaguagagugagaagaacgugaacuucagagcccacccaucccguuucacauuugaaucgcaacucugucauucaccagcugugcauccuugggaaagucacuuagccucucugagcucuaauuuccucacagggccgcaggacugagguuaaggaccugcugucacugguacagugguugaagaaaaggugaaugaaggaagggccucguuuuacuccuugucucacauuccuuucugcuacuucucuuuggcucaccaaaaggagacagaaguuuguguccauggcugugaacugccaaagaguugccaauucucuacgaucuuugaccucugugaucccaggggcaaggccagcacuuuccauuccauuagacuucauucucuugugggugcuuucugcuggaaucucccaauacagaacagaaagcacagguuauggaaucagauagaccaaaguucaucuccaaauuugauucccucugcauacaaguugcuuacccuugggggcccuguaaaaugaccauaauaguaagcaccucugaggcucacuggaagaacucuuuguugucugcacagaagaucucagcacuaagccuggaacagaggagacuucagucgauguagggcaucuccccaaacugcuuuuauucuuuaugccucacugaaacuugaaucaaaaagcggcuggaggaaaaagagcuuugccaccgggcaguacugcugggucuugcgucacagagaugccuucugcucccuucuucagggagaccucagaguaugaaagugcugcuuacccagcagaugagauuuaguccagucauccaucugcguggucucuguggauaaaguaagcguuucauucaacuuuuaaaaauauugcaaauugacccucgcacaucuuuucuuacugccggucaccuagccagcaaagaccccaggugagaucccacugguuuggaggaaggagaggaaaguccccacuugggcaaaaacaauuuaggauaccugaagauugcaaagcccagcuccucacaaaggggguggcagcuggggagaagcugaaucaguagacagacaagauugugguuuaacgaguucagggacaagagaaggccccaguaaccuacagaagcaacuagcuccuugccuucuguacaacauggccuuuggagucacaggacgugaguuuggaucccagcucugccacuuaguaauuguguagauuugcacauguugcuggaccucucuuugucucaguuuucuguaaacuggggaaaaucuuaguaaaucuagcuaacgugguuguuaugaagauucugugugugugugucuguguguguguauguguacaaagaaaguuuagagcagcguguggcacguaaugcauauuauguaaguguagcuccaaugugaguuguuacuuguagagaacagcuaugucaaaaccacaccaaaaacgauuuggaaaggaaauaauuugacuggucauuuuguuuauccaucaacugaguuggauugauauauuuuuccuuuggccuucaaaggaaauuugagcauucauucauucauccuuuuagagaaauauucucuaagcaccuaccgugcgccaagcuuuggguuggauaccuggaaccccucucagugagaucacagucuaacagcacacacccaacuaugaaauauagauggacugugaagaugaagaaagguucugguuaugaacucacagaggaagugacggcugaacuuuguaaggacacaagugguuuaacaaguuuccuggcccauaugagaucucggcuccgacguuacaggcagcaguguggggccucaccuuaccuuuucccacuuccauccuucuccacccccguucaguucccaggcuccccuugugugaacuggcucauuucucacugccuuucuguucuacagcccccgcucugcugagucaggaggugcuacuuucuccaucugcuuuccaucguccaaaauuuuuguugauguuucuugaucacugaguuaaauaauuuuuccccguauuauacauucaguagaguuucuggagagagugcauacaaaaacgccuaacugaaucuaccacgucuaagcagaugcucccagagucuaugcuuuuuucccccaugccauacuccccaaacuaaaggaugagaaagaaccaugcaggcagaaugagaugaguagaugcuacugcuaaugcugucaguucuacuacuaccgccacugcugucuucugcugaguauggauuauaugccuguuccauaugagaacauuaugcauauggugugauuuggucauuccggauggcuaaagugugagcauacccguaucucagauuuacagaggagaaaacagaggcucagacugguuauguauauuucucuaagucccccagcuauuguuuguuguagguuggguaccccaggaaguagauucugcaacugagauuggcauguaggaagauuacuggggaguguucuaggauccacaccuguaggggaacguagcaagcaggaugggguggagggaggauugagcugugcugugggagaugcgaaugcuccagucaaucccaaggaaacucugaagcuggauuauucuucagagaugcaaggaggucaggaagucauugaugugggcucccuccuggagugcguguugcuuugguagggagcucgcuuuggcugugggcaguuccugaggagggacucauaggacagccuagcaucugaggaaaugagugccuccuggcccagaaugggggaucucagcagcacacuacaauauccacuacaguuucuugggcuugcucugaagccaugccucucuaacuucaggguauauucauguaagugaggugcagggaugggggaaagggagaagguaaagcuacaaagguaagccagcuugucuagaccgggagcuagcuccuugugaaggaauggcaaugauaaugguuaagucagauucaagaaguguguuuuggggaaacacuccagguagugguacauagaauccuagcacaagaucagugacugggugaguuugacauuguagaugcaaaugugugaggaauuauaguugaaaggggaaagaacauuucaguuuuucauuuccugcgucacuguuuuucuuauuuggagaugcuguuccucucaagugggaaaaauuugguuaucucaggugguaaagaugccuuuguuuaaaauauucuucuguuaguggggacaauaauacuacuaauuucuaguacugacgcuucucaugcaauuuaaucaguaggaaccuguuugcauguucauuugaggaaguaccaaagccaaaaguagcuucgagguuuggcaccucugauaaaguuacagaagugcagugugagcaaaaaucauccucuucucuguucuucaccuguuggugaacagugagagaccaaggugagagacucggaaauuacacauguacauuguauauuacauguauacaacauacauuguguauuacacauauacaaauuacuugucauaacgugcagauuucacaaugagagaccaaguugaaaaaugcuuaaaauucacaagucuauaucauucuguccuccagguaccccaagcugguuuggguuuauaccaguuugaaccgagggaccuucagcugaggaacaugugcucugugugcuggaagcuccuggaggccccaggguuaucucugcucacuuagguuugugauguugggcaaaaggagaaaaugcugagucuauucggacccaacuuccauuaaugccugagaaauaauuuaaaucgcaagauuuccaaucccauaagcagcccuagccucucuucuccugauacuccacauacccagucuccauuccuucuucccccacccuccaguucucauccuguacacuaccuccagacccccagggauucagauccugucucccccaaugagagacuuuuuuuuuuagggggagccaaauuauuuguuacaacauguagauuucacuuguuguagagauguucuauuuucaaggauacagagcucaaagggagcacaauucccuggagagcuagggaaauaaugaagucuaaggucuggcagaucuggaucugaauccuggcaaugcauuucgggaguucggugucacccugagcaucuuucaauuccuugaacuucagucuccucaucucugaaaugggguuauuaucuaccugcagaggugcugcaguauuaacugaggcaacguugcaacguuucuagaaugauauuuagggcucauauugacccaguaggaaguauaguuaccuugggccaggggagcuaccugaguggagucaacuuuuagguuauagggaccaaguugaaacaugcuuaaaauucacaagucuguaccauucuguccuucagguacccuaagcugguuuggguuuauacauucccacagugccuaccacaucccaauggcuuuaugaccuugagguccugaucuguuuuaucauagcucuugaucuuccucaaaaauucuuacagcuguauuccacaggucaucaccaagggacugcuagaacuggaucauagcagcuuccaagagcugaguguguacauuuccucccaacucugcauucaguuuaaauugcuuguggugagaguauucauaccaugggaauuggcagacacugugaaucaaacccacccccugcacugccccccuccagugagcgaguucuugaacacuuacugguacaccacugucaccaacccugcuuuuuguagacauguccuuuaagcaaagcaauucaugggaaaguaaauuuaauuaucagaccauuucauuagauuccucacugccacaaacaggugguuguggugauaaucugggcuuuuuugaucgcuuuagaaaggcaguucuguaaugacaugaaaaacauauugcuugguaauuuauuuauuuguucccaauguuugcuacggauuguggugaaaacacaaacacccaggacaaagggcaagguucaucccaccaugacgaugggaggcaguuucaucccaccaugaugaugggaaguccuuauaucaggacuccagggaucuuguguccugauauaaggcucucacuuuccaaucagcaggaaguuaugcuucccagccucuaggaaagcauaggaguuaaggagaacugaaaucuggggcaguuauaaaucuucccuuauguguacaacaguuuaaaucaauuggucaucuaccaaaaucugaggaacaagagcagcuuuagaaaaugggcugggcaugguggcucaugccuauaaucccagcacuuggggaggccaagacagguggaucaccugaggacaggaguuggagaccagccuggccaacauggugaaaccccgucucuacuaaaaaaaaaaacaaaaaccacaaaaauuagcugggcaugguggcaugugccugcaaucccagcuacucgggaggcugaggcaggagaaucgcuugaaccugggaggcggagguugauguaagccgagauugcgccacuguacuccagccugagugagagacagacugucucaaaaaaagagaaaaguaaagaaaagaaaagaguaagauuaaaaacaaguaaagaaaauaaauccucccgcuuuuuuugcuccuucauggguauggcugcauccucugcucacugguuugaguuauuauuuucccaugggcaauuaaagcccuggccuccacugcaguuuucacaucaaaccuaagagucucaggugccccuugguggagcaaccuaacuagagacauuaaucauacuacgggauaauugacaaaugcauugugagugucugauuucuguggcucaggaugcuuaguagcaguggggucaagggcacagaugacacagguccaaauuuccccaccccuacguaguagcugugugaccuggggcagguugcuuaacuuuucuggacuuuugauuccacauugguuagauggaaauaccauauuauuauaaauauuguaaauaguacccaucaaacacuuaaugugaaccagaaacccucauaaaauguuugcuagucuuuguuguugaaaggucacuaugaugauggcucaaaauccugaccugaaggugugcuauguuccugcuucacuugugcuguggacauguuccuauuuaucauagugcaguuguugagacugggugucuagagccaugugauuugguucagcuccuaacucugucacuugcucuuugaccuaggcagaaaacuuugccucuuugggcuucaguccccgguguuuuuauuuuauuuuauuuuucaagauggagucucauucugucacccaagcuggagugcaguggugcaaucuuggcucacugcaaccucugccuccuggcuucaagccauccucccgccucagccucccaaguaagugggacuacaggugugcgccaccacgccuggcuaauuuuuguauuuuuaguagagaugagguuucaccauguuggccaggcuggucucgaacuccugaccucaagugauccaccugccuuggccucccaaaguguugagaucacaggugugagccauggugccaggccucuccugucuuuaacuggggauaaugugugcagaauucccccuaaaggaucuaucaugcguaagguggacccucacagaaagcgucaaagacacacgaaucucuuagcaggaggccgccagguggcacaaaaucaaaacugcaucauugagaauuauguuaugaagucauuuacugacuugagccucaguuuuccuauuaauacaaugagacuguaguaacuucauagggcucuugcaagaguucagcuaaaauucuccaccuugccaccuagaacaugucacagaagguauccuggccccuguaugggauucauacaugaagaggacugccuuguaaagucauuugauuagggauccagaggguguacugguagaggacagauuuucaaccccuugacaguucgaaggucagcuacacaacuggcuuguguuccucgcugacaccucccugaguagcaaugugcauuugugugccuucccuuugccaggcauuucuaagaggaugaauccuaacagguauggcagccagagggcaggggcagggagaagaauaagauguuccuugguguaccccauugucaugaguucaucauuucuguuaacugugggggcagagaguuccaauugcaacuggcuuguugugagacugccccggugguugcugccagaugauccacaaaugccaagcuccucaccugagcccugccagccuucaggaccuccuuugcacgaagagcaauuugcagaagagaacacugcaggggaggcaccauagaccccuucuggucuguacuguucaaaaucacaugacauccgccagaggccuggugggaagccaggguuuuaggcacuagaaauggagcucagaaaggaggagaaaggucccugcuggucuguggagagggccuuggccaccagagggaucaaauggcccaggcaggaaauaaguaucccgcucucagaucugaggccagauuuucaaguguaugcaugauucuggggugcuacaaaggguauagaguauggaguuagaacauuacacgucaacaagaauauggguuuugaacccagaccucaguuugaaucugaguuccagcacugccccguugcuuggccgugaguuacuucaccuccuuuagccucugucuccccuccacuacaauaacaccugccugguggggagugaggauauugugcgaaucagaaguaauaacaggucguuggcaccuaagagacucucaguaaccagcagucaucaccaccgucgucgucuuuuuuuuuggccauuacaguugggauuagacuaacccucccuaagcagcuauugagccucacacucccuggacaaagacaugaaaaacucuggaugauuuggaagggagaucuagaaauggugaaaggacuggcaagugccucugugcugauauuguaccugggcucaguggucuggcuaaaggagaggugcuggggccaggugacaggcgagucucuauacggcaggcccaaaaaauggaggugcaggcuucaucuauacuuugauguguaugcuuccuucuuuaaacuugugauaaucagaguuauagcugcuuuaaacuuguaaaaaucagaguuauagcugcuuuugaacuaguacuuguugugugcccaggaaauggccaaauguuaucacucauccuuccaagaaacacaugaagguuauauuauuaugucgacuuuccagaugaggagacugaggcucaguggcuugucauaggugucaaagacaggaguccaauguaaggacuucuggcuucagcacaggggauuuuccuaccaucccauauugccaccccaucugcaaaaauaccuggaucuaucuuccuccugcugauucucagcucccuccaggacugaagagaugauauugauucucacuugauagagguuagaaagggccucucccuucccuagcugaauagagaggguuuccuuuuucuuuucuuuuuuuuuuuuuuuuuuuaaaugggaaacuuacagggaauaagaucuguuucuucauuugcuuugcaagagaguuggauuuguacacgaugccugagcuggcucgguuuucuaaagaccuaacuuugcagcauucuucaagggcuccagagagucccuugugccaucaaauuaaguuuggaaacuucaauaaaaaagucccgaaggaaacugucaauuaaugcauuuacacugaagcaucauauuugggaaaaacaucuucaaacgcaaacgcuguuuuccaaccauuaaaaaguuuaugcgcugcuugguuuccauggauaccugagguaauagccuccuuccucucauugaagagugaauguugcucaguuacuuuuuuccuguuuuuuuucacuuuugucuuccugacuuuuuucuuccaucccuauuuaugaaaacaaaaagauaacuaaauugaaaccugacaauguaauuugucagaggaaggcagccuguuuuauaagcucaggugauuucauuuuuguucaccuguuuauuucaugacacuugcaggaaaaagaagaauuuucauuugaucaaaucauuuccaugauccaucaaacacacaaguuaaaaagggaaaugcucucagucuuuaauaacagucuuaaucguguguagagcagagauugacaaacuauggccugccggcuaaaucuggcccagugccuuuuuuuuuauaaauaaaguuuuauuggaauacagacacguucauuuggguagacguugucgauggccgcuuucacaacaauagcagaguugagugaucgugccagacauuauaugggccacagagccuaaauuacuuaaucucuggcccuuugcagaaguaguuuacugaccuauuauauacaggaaagaaugagggcuuggguggcacuuaguaguguugucacuuuugucauuggccuugaccugacucagucuccguauuguugagaugggaaugacgggacccucaguaguguuuugggauauaaggcacacgguaaaggaacaacaaauaggaauuacauuccgucgagauucuuuugcuagaaagauccaaagaaaccuaccuugugauucuagauguuuuuuaggaaacccaaagaaaguaugaaaaagcccaagccaaguccuuccacuguuguucccgggccugugugugcugugugucuuuccugggagaaggucagagcuggaguggggcacucgauuccggcaagagaaggcaaacaaaagaagccacaacagucuaggaagaaaucuuuaauuucuauucagcuuuaaagaguuugagagaguuuuuuccccucuguuaacaaacgaguucaaguacaugccuucauauuauaaaaguaccugaaauugccuagaauagcagcaugcauagcuuguuaguauuuacauauauuuacauagggaaacaagagaaagaucuacaguuauuuacagucuacauaggggaagagaaaggcagccuaauuguauuuccuaaaauacaguagaugaguagucagcacaugcauauuuagauaauauuugcaugauagaaugcaaacuuuaaaaaagacauaccuuuguaacuuucuaugcuaagguguugcauaaucaagguuaauuuuuguuuguuucuagucuauuggcaucaagugcuuuaaaaugcucacuaacaccgaggcagaauuauuuacccgggcaauuaaagcaacagcacacacgaucauuuccuacuaacuagcaacacgcugcuggugaaugaaauaucuauuguuucucauuacccaucgaccacugugaagagaucucucuguguaaaggcagugccuaagcuaucaccauuaauuauggaaguaauauaaaugagacacucuccacaguauguucuaaaugaaauauuaacaaggccagcgucuuggaaccugagaaauggucuguuccagugagcucuguauggaaauccacacaccuaacucagacaugcccgauuugaaauagcggggcuggacauugggggccuaccugugagaucugaauuauugcaaaguacauccucuuaauuuguuucuggaaggcagaguuaagaguuaauuccuucccaugauguggccccagcggagaccuuguguuuuuuuuuuuuuuuuucuucagugcuuuuucaggacuauguuauagaauacuuauggggcauacguguaaaugaacugucaaccuuaaaaucuaaacaaacagcuuguuugugguucguccugaaauccucccugcucacaaaacagccagcuacuugguuuucuaaaagacguaauuuugcaggcagacuucguagagccauucugugcagaagaagggaagggagaagcuguuuguuuuaccuguaguaugaagauauucuuugcgcuguuagaacugagcucauuaauucugccuggcaauaauuucaaagguuuauuuugguguagauggcgaauacagaugcauacauuuauacgcaguacacgagcuagcuauaaccauaacagagguuaaagaaguagaguaaaaauguaaaauguuucaaauaaacacacacuaaauaucuucuuuuauaucuuauaaacacccagcaguccuuuagcacgggcaucaagguggcccaguuggaaaauuucagugacaugccaucagauuuguuccauguagaaggacgacacuaucaguuagaugcuuauuuuguuggcaaauuucuauggcacuucugcuuggcuauuucaaaccaaccauggaagaauagauaccccaaugcgauguuucaucccuauucauaaagaaacuguacuuugagcaauguagguaucccaggcagcaucagagggaaugcccagggaauucuuccauggauauaagacaucaucaacaauaccuucucuuaguucuaaugagacagccucucagguccggucaguucuagaacgcuuugggcaggcacaaauggaagauggaacaagugugcauguaaugacccacauggauugccuugaagccguuucuuuuuccuucccucguuaggaguacccucacccuaaccccagcaaagcaugucuagggucucacaauaauagcaggucucagaaagauaaaauaauucugaauguuacaacucgucccauuuaaggcuagacauaaaucuaucacagauccuuuggaacaucgauggcaagaauucuggaacacgaaggagguaugaaaagggcuucacucguuucauggaaaagcucagaacaguuugucgacuuggaaacacaggcccugagagcguaccaaggucacccugcccuucaauccugcugauagcccaaguuaacauccucccaugccuuggccuucccagaacaaacauggcuuuggacgccuuugggugguugggacuggcugccuauuuuucucuaaaacuuaaguuuuaggaaagaauucuuuccagcuuuccauccugaaccugcuggucuccaggcucguuccugcaaauauuucacagaggaguaagagccacauucuugcuggcuuuccaauucauucuccucucuucgaguccaccucuuaaaacuucuuagugcucuugcaagaaacucaugucuuuugucagggagaauggcauggccuuuguaugacacuuccuucuagccagacucggauuugggggcaucauauuugggauggcugcaccguaaacaggaaaggccacaggacagcucacagguucucucugaacagaagccugugagcacgugccugucauuuaaaagcugcauggcacucuucccccugcaugcguuucucucaaggugucccuuguaauuugugguuguggucugugcuugaaccuguugcauuuauggugauggacuggcacuuuacucucucugagccacggccaucaagccccugucauagacacugucccuagugucaccuggggaaugacacucuucaccugucaugggagaggcaacugaaaaggagccugagguuuuucuaccuuugugaaccuguugcuagcaaagaaauauuuuuccuuguggcaaaagaucaacaucuaaacacauuguccacgucuaauuuguuagggagggcauguucucuucuggagggcuaagaguuggcaugggaucuaaauggauucuccagaacacuuucucacacuucuaaagccugaaaacaaauauuugcuuuccugaucaucuucauuguuucuuuuugggaaauugagugcauuccucuucuauaauaaagguuaagaauagccugugaguuagcaaaacucccaaagguuuaugaagaaaguuacauuucaauaccuacaggaaguauuugcaugugucuaaggcuggauuguugaaggccuuugugggagucaguugucaggaauuuguaggaaugacuguguuaggaaucauuggaggagagggagucagagggauggaucaguauuuucucugcaaaccugaugaaacacuccagagcccgcaccuacaugcgugggaacugauaagauggggguuguguccacuucacuuguaugggaugucggugcuuugaaaaaauucuaucaucaaagaguagguuucuuaguucugcaaaucuggcaccuggagauggcauuuugaaucggacgaccuuuuuaguaagggucacuugcuguuggaucaucgaagggggugcugagucuucauuuuuguucauccaaauggauaucauuucaauuuagcuccaugaguaaaucaauggaaaaaaaaaucuccuuuuaacauuucucgggugaacacacgacagcccccacauuucauuuuaggccauguuagggcaucaccucauggccagacauggccuggcugagaaggcggcagagcaggcagagaggcauaggaagccggagccccguggaagacauagaugaggaaaugggccacgugcaaauauuugugucacauauuuggggagcagguuucauguaccaacggacacggagucugaagucacucacucuacguaauuaucuguauggcuuuggacgaguugcuuuugaucucugauaucagguaggcuucucucuaaauaaauggaaauacuaacugucccuggcucauagagcucugugaggguuaggcaacaaugcuuacaaagcucuccaugcagagccuggcaaaucguaaccucucaauaaaugcuagucauugaugucacuugaauaguacucguuggcuacaacucacugaaaaagccgggcaguuugcagggcugaggacuuuggaguagacaucucuguucucgucugcugcuucccaucauuuugguggaaguugguguguucguugguuagcacuuauuccaaauugaauuguauaauuucauuauagaaguaucacgguggaagaagagggugacuuacugguguggucaccuagccagggaggccuaugagccucauuccuguauaggcugcauuacuuuaugaacaaaugcaauuuguggcaaauguguccccuaaaagauugcucuuggauagugaguagggaacaaguggccuuuuggagcaguuugcuuucauuuguguuuccaaugagagauugaagcuguaauuguuugugaggaauggcuguaucccaagcaccgagguaucuggagaugaccucugcacuguucugggagagugguuauagccucuccugggggaguguuacugggagacagggaaagacagggcguguagacggccaucuauuccaccugugacaugagggcucacccccucaucuccaccgcagcagcucucugauaaauguagcucucugauaaaugauucuguuccuagugguguauucacagagucaauggauaagguggcuggcuuugcauuugagaaguauuugcuuuguccaacagacaccagaugaguaacaauggaaguaggcaggguuugaagagguaugugucuuuccuuuuagccaaaccugcucacuucagaucaccacuuuguccugggacguuagucaugggaacacugccgucuucaaaagggcuguucuccuucccugcucuugguguuccaagccuaaucuaacuuccaggguucauuccuuucauaacucuacuuuuugcauaaguggauuaauucagcauuugcugugcaaugucccuguaagaaagcaaucuuagaacaucuacucucucacaaucauugaauauauagauaugccaugauauugugucuauuuuuuauauaucucauaguuaagucuacuuuaagacaggaaucuccucuuucuuuuaaaugagcaugcauuuuaaaauagaaaaaccugaaagcaaaacacgguguaacaugugucccugugaguauuauauuagaguacuaaccaaugcauuacaaauaucaauaugugggugcuuuuuuuuucuuuaccauauauuguuuaucagaaaccucuguacccuuuccuuuaaaggagucaauaugcauuuguauucugugcugacaacuauaaauugauggcuagcaguuaucaaaugaauguugaugaaaagcagcuacuuaacauuuucaucccaacaccgaguuuuggaaggauggauaauuuagaucugagggccucaacuauaaauaaacagcaacugcuuucuaaaucccaccuuucuguaguugaagauugugcugcaaaucugacagaugauuuuugaaagagaaugaugaauccuuauuaccaagauacucuuaaucccaaacaagaguccuggguaauuuuacauauacucucaagauugauugcacaguucuccucuggcagcucacaaauguuugacuagaucggaaauggcauucgggcaugauuaaaaagauucuucugggcuucccagaaauucucaguccugugucgucaacaaccuaacucauugccauugcugcgggauagacaccucccccguuucccaugauuagcaaccauauacaaccuacaggcuucugauaaaugauugauucucaaaaaaaaaaaaucguuuaggggaacccauagcuccagccaguguuuguaugucaagguauuauuauuuaucacaauggaucaguaagcauugaugacaacuggcaagguauugcuucagauauuuuauaacggaguuguuaacauuauuuccuuuagauggcucuuucaucuuuucugcauuaugaacugaugccccaaaaggugguaugaaugaaagucaucugauggugauuaaagugcucuuuaaauuuuuuuuuuaaucaguuuaagaaugcuuucucuuuuauuggcaguaccugcuuguuuacuauugagauuucacuaaugugccucagucuuauucugaugauauguaggccgaaaagcuggugagccaaaaaugagaaccuguuacuaaacugucaucacaucugaucauauuaagaugucacucagagguugccauugguacggcugaaaauucuccaagagaccaaaggugugguguguaugggaccaacaagauauuguuacugcuuaauuguccagcaagggaggaaaguagagugaguacccaugagcaccaagcaugaaucugagaaggagaauuugccaaagguggacgauugauuuuuggaguagagaaggucgucuuugcuuucgggugccccuccuguguacuguguucuacaaagccagagccacuugugauggaauuuagaugguaaaucaccccaagccuaguggcaaaggaaucaaagccaucuccugauaaaaaguuaggcuuuucaaaaagguauggcucucagcauuguagccaaauguagguuggcaugaaaugaagccaguuguaauugccuuuagauuccguggaaggaaaagguagguccccagcuccugcaacaauggcauucugaaucaaugggacugcagaauuucuuagcaaaaauaccauuccaguaaugcaagagugcaacgugguaucauuacaguaggucauaguggcaaaauauuuuaucagguuaggaagaauucugcuuuuugcuuucccaaacggacugcuuuggucuuuccucacgcuuggcagaacagugaaaggccagucugucaugacguuugaaugcugaauaguauaaccauuguggcauagagggcgggaggcuggacuugaaaugggugagcuggauucucccaccacucgggaguuaauggcaagucacuuggccacucuggucguuuuggcagcugcaagguaaaaugaaaauauaugacagauaucuggaaguugauacaaaacaccaucuccaccagaacucuaagauuccaggccaaaauaauacuuggcuugaguuagcuggaugagcaucucaauucuccaauuugucuuuagaggcacuucugcuucccuuuuccccacaugggaugcagaagagccagauaaaccccuugaaguuguuuagauaaaugugccaggugcuaagcucaggguuauuaggaauaauaauucagugaaaggaaauuuggaugacaugaacucauuuccauuagacuugagccacacaaaucaaugggaaaagaaacagcugaauccaggauaauaucuggcuauuuggagugggcaugauaauggagggagauuggggagguaacaaaccagcuacuauuaaguucaagucaugucaguuauucaaauucaggaccaguggaacuuguccaguaucaucaagcagccaguuauuaucaaaacccaagucuuugucucacucacgguccacaccccgcccagagucguaucacuugacugcauuugaccauucaguuuucagaccaacuccauuguuacuagauauccugacacugaagaagcuaaaaccaaacaacaaugacaacaacaaacccaagucugccuuauggcagauucuucacgucguaacaccuuccuugggacccuauuucucaguauggaccugacucucccagggauccuagaaugcaagcauagugauugcaaaccagaccauuugagggaaacuccuccaguaagcacccugcauggucacaauguaaacccugcaggggcagaaaaaugauaagcuuugggucgggucggaaagccauuucccccacaaucaaaguuccuuaguguuuuccuugugggggcgagcuuaucuucaguuaccuuuuccgguccucucuugcaaccccucucccucucaucagcugaaaauuaguggaugcagcuagggcucugaaacacauaaauaaucauaagaugccagauaaacuguauugguuuuaaauuagagacgugccgaccaugucucccucugaacagcagccuauuauuuuuaauuauggcuugcaaagcaaagugauuucuugcccucuuuauagcaucccugacaguauucugucaguuuggaugauaugaugccucaucacugcacacgucccuagccacagccgcaacuguuacucaaaaggugaaugaaagugaucagcugcacucuuugcaacuuacauuuugaagugggcugggaggaaauguacccccuuaccuguggucccauuguaaaucugggucaaauaugacauuuagaaaaagguuuucaugggaucuggaugaauuaauguguuauguguuugugcuaaguaugaauguauggugaggagugugugugugugugugugugugcauuaaauguuuuaacacaacauugccaacccuuccccuagcagcaccgugggcaaagcauaaagggaugaucuggcagcagccccacuuggguuuucuaccugauggaccacaauuaagagugguugguuugucagacagaagguucuacaaacgauuugguaucgaauuacauuauacauggagaaguugagggguuggaugaauuuguucuugcacguucagaaggauaccaucuuuuucucuguguggaagaggcgccugccacgacguauugauauguguauuuauuuuccaagccugucccuguaugaggugucaaaaguuacaccagcuuuacaagcggaguuuaugaacucguuuuuccaggauagucacauuauacuuuuuacagucaugugcuuucagcccaguacccuuugcuaugccaagauccagcugaaacugaaccaggugggggaggccugcuaaugcccaggcagucgaaaugacgccaucucaucacuccuuuucuuaaaauuuuuuuuugucuuucuucuuggauuuccagcaacagggagcugccaccaccguguacugugcugcugucccagaacuggagggucugggagggauguacuucaacaacugcugccgcugcaugcccucaccagaagcucagagcgaagagacggcccggacccugugggcgcucagcgagaggcugauccaagaacggcuuggcagccaguccggcuaaguggagcucagagcggaugggcacacacacccgcccuguguguguccccucacgcaagugccagggcugggccccuuccaaaugucccuccaacacagauccgcaagaguaaaggaaauaagagcagucacaacagagugaaaaaucuuaaguaccaaugggaagcagggaauuccugggguaaaguaucacuuuucuggggcugggcuaggcauaggucucuuugcuuucuggugguggccuguuugaaaguaaaaaccugcuugguguguagguuccguaucucccuggagaagcaccagcaauucucuuucuuuuacuguuauagaauagccugagguccccucgucccauccagcuaccaccacggccaccacugcagccgggggcuggccuucuccuacuuagggaagaaaaagcaaguguucacugcuccuugcugcauugauccaggagauaauuguuucauucauccugaccaagacugagccagcuuagcaacugcuggggagacaaaucucagaaccuugucccagccagugaggaugacagugacacccagagggaguagaauacgcagaacuaccagguggcaaaguacuugucauagacuccuuugcuaaugcuaugcaaaaaauucuuuagagauuauaacaaauuuuucaaaucauuccuuagauaccuugaaaggcaggaagggaagcguauauacuuaagaauacacaggauauuuuggggggcagagaauaaaacguuaguuaaucccuuugucugucaaucacagucucaguucucuugcuuucacauuguacuuaaaccuccugcugugccucgcauccuaugcuuaauaaaagaacaugcuugaa
